(12) United States Patent
Lowery et al.

(10) Patent No.: US 7,763,262 B2
(45) Date of Patent: Jul. 27, 2010

(54) ATTENUATED YIAO MUTANTS OF PASTEURELLACEAE BACTERIA

(75) Inventors: David E. Lowery, Portage, MI (US); Troy E. Fuller, Ceresco, MI (US); Michael J. Kennedy, Galeburg, MI (US)

(73) Assignee: Pharmacia & Upjohn Company, LLC, Kalamazoo, MI (US)

( * ) Notice: Subject to any disclaimer, the term of this patent is extended or adjusted under 35 U.S.C. 154(b) by 0 days.

(21) Appl. No.: 12/425,599

(22) Filed: Apr. 17, 2009

(65) Prior Publication Data

US 2009/0202594 A1 Aug. 13, 2009

Related U.S. Application Data

(63) Continuation of application No. 11/251,464, filed on Oct. 14, 2005, now abandoned, which is a continuation of application No. 09/545,199, filed on Apr. 6, 2000, now abandoned.

(60) Provisional application No. 60/153,453, filed on Sep. 10, 1999, provisional application No. 60/128,689, filed on Apr. 9, 1999.

(51) Int. Cl.
*A61K 39/102* (2006.01)

(52) U.S. Cl. ............... 424/255.1; 424/184.1; 424/190.1; 435/243; 435/252.3; 435/320.1; 435/325; 435/69.1; 435/253.1; 530/350; 536/23.1; 536/23.7

(58) Field of Classification Search ................ None
See application file for complete search history.

(56) References Cited

U.S. PATENT DOCUMENTS

| | | | |
|---|---|---|---|
| 4,735,801 | A | 4/1988 | Stocker |
| 4,826,764 | A | 5/1989 | Sebald |
| 4,877,612 | A | 10/1989 | Berger et al. |
| 5,077,044 | A | 12/1991 | Stocker |
| 5,284,933 | A | 2/1994 | Dobeli et al. |
| 5,310,663 | A | 5/1994 | Dobeli et al. |
| 5,389,368 | A | 2/1995 | Gurtiss, III |
| 5,547,664 | A | 8/1996 | Charles et al. |
| 5,585,277 | A | 12/1996 | Bowie et al. |
| 5,587,305 | A | 12/1996 | Briggs et al. |
| 5,840,312 | A | 11/1998 | Mock et al. |
| 5,876,931 | A | 3/1999 | Holden |
| 5,994,066 | A | 11/1999 | Bergeron et al. |
| 6,020,474 | A | 2/2000 | Bandman et al. |
| 6,214,591 | B1 | 4/2001 | Tomita et al. |
| 6,242,194 | B1 | 6/2001 | Kullen et al. |
| 6,376,211 | B1 | 4/2002 | Little, II et al. |
| 6,410,021 | B1 | 6/2002 | Fuller et al. |
| 6,506,581 | B1 | 1/2003 | Fleischmann et al. |
| 6,531,575 | B1 | 3/2003 | Bandman et al. |
| 6,673,538 | B1 | 1/2004 | Goldstein |
| 6,790,950 | B2 | 9/2004 | Lowery et al. |

FOREIGN PATENT DOCUMENTS

| | | |
|---|---|---|
| WO | 94/11024 | 5/1994 |
| WO | 95/20652 | 8/1995 |
| WO | 96/17951 | 6/1996 |
| WO | 97/09433 | 3/1997 |

OTHER PUBLICATIONS

Wells et al. Journal of Leukocyte Biology, vol. 61, No. 5, p. 545-550, 1997.*
Bork et al Genome Research 10:28-400 2000.*
Ames et al., "Pulmonary Response to Intratracheal Challenge with *Pasteurella haemolytica* and *Pasteurella multocida*", Can. J. Comp. Med., 49(4):395-400, 1985.
Ausubel et al. (eds.), "Screening of Recombinant DNA Libraries", Current Protocols in Molecular Biology, John Wiley & Sons, Chapter 6, pp. 6.0.3-6.4.10, 1994.
Belasco and Higgins, "Mechanisms of mRNA decay in bacteria: a perspective", Gene, 72(1-2):15-23, 1988.
Biberstein, "*Haemophilus-Pasteurella-Actinobacillus*: Their Significance in Veterinary Medicine", Haemophilus, Pasteurella, and Actinobacillus, M. Kilian et al. (eds.), Academic Press, London, pp. 61-73, 1981.
Biswas et al., "Cloning and functional characterization of *Neisseria gonorrhoeae* tonB, exbB and exbD genes", Molecular Microbiology, 24(1):169-179, 1997.
Blattner et al., "The Complete Genome Sequence of *Escherichia coli* K-12", Science, 277(5331):1453-1462, 1997.
Bramlage et al., "Designing ribozymes for the inhibition of gene expression", Trends in Biotechnology, 16 (10):434-438, 1998.
Braun, "Energy-coupled transport and signal transduction through the Gram-negative outer membrane via TonB-ExbB-ExbD-dependent receptor proteins", FEMS Microbiol. Rev., 16(4):295-307, 1995.
Callebaut and Mornon, "Trigger factor, one of the *Escherichia coli* chaperone proteins, is an original member of the FKBP family", FEBS Letters, 374(2):211-215, 1995.
Cane et al., "Harnessing the Biosynthetic Code: Combinations, Permutations, and Mutations", Science, 282 (5386):63-68, 1998.
Carter et al., "Transcription attenuation in *Salmonella typhimurium*: The significance of rare leucine codons in the leu leader", Proc. Natl. Acad. Sci. USA, 83(21):8127-8131, 1986.
Chakrabarti et al., "Role of DnaK in In Vitro and In Vivo Expression of Virulence Factors of *Vibrio cholerae*", Infection and Immunity, 67(3):1025-1033, 1999.
Cheng et al., "The vacB Gene Required for Virulence in *Shigella flexneri* and *Escherichia coli* Encodes the Exoribonuclease RNase R", J. Biol. Chem., 273(23):14077-14080, 1998.

(Continued)

*Primary Examiner*—Robert Mondesi
*Assistant Examiner*—Oluwatosin Ogunbiyi
(74) *Attorney, Agent, or Firm*—Timothy J. Gumbleton

(57) ABSTRACT

Gram negative bacterial virulence genes are identified, thereby allowing the identification of novel anti-bacterial agents that target these virulence genes and their products, and the provision of novel gram negative bacterial mutants useful in vaccines.

16 Claims, No Drawings

OTHER PUBLICATIONS

Cianciotto et al., "A Mutation in the mip Gene Results in an Attenuation of *Legionella pneumophila* Virulence", J. Infect. Dis., 162(1):121-126, 1990.

Cianciotto et al., "A *Legionella pneumophila* Gene Encoding a Species-Specific Surface Protein Potentiates Initiation of Intracellular Infection", Infection and Immunology, 57(4):1255-1262, 1989.

Corey, "Peptide nucleic acids: expanding the scope of nucleic acid recognition", Trends Biotechnol., 15(6):224-229, 1997.

Crooke and Wickner, "Trigger factor: A soluble protein that folds pro-OmpA into a membrane-assembly-competent form", Proc. Natl. Acad. Sci. USA, 84(15):5216-5220, 1987.

Davis, "Cholera and broiler breeders", Poultry Digest, 20:430-434, 1987.

Dewhirst et al., "Phylogeny of 54 Representative Strains of Species in the Family *Pasteurellaceae* as Determined by Comparison of 16S rRNA Sequences", J. Bacteriol., 174(6):2002-2013, 1992.

Dobrindt et al., "The leuX-encoded tRNA5Leu but not the pathogenicity islands I and II influence the survival of the uropathogenic *Escherichia coli* strain 536 in CD-1 mouse bladder mucus in the stationary phase", FEMS Microbiol. Lett., 162(1):135-141, 1998.

Duim et al., "Molecular Variation in the Major Outer Membrane Protein P5 Gene of Nonencapsulated *Haemophilus influenzae* during Chronic Infections", Infection and Immunity, 65(4):1351-1356, 1997.

Elkins et al., "Role of the *Haemophilus ducreyi* Ton System in Internalization of Heme from Hemoglobin", Infection and Immunity, 66(1):151-160, 1998.

Engleberg et al., "DNA Sequence of mip, a *Legionella pneumophila* Gene Associated with Macrophage Infectivity", Infection and Immunity, 57(4):1263-1270, 1989.

Fernandez De Henestrosa et al., "Importance of the galE gene on the virulence of *Pasteurella multocida*", FEMS Microbiol. Lett., 154(2):311-316, 1997.

Fields and Song, "A novel genetic system to detect protein-protein interactions", Nature, 340(6320):245-246, 1989.

Fields and Sternglanz, "The two-hybrid system: an assay for protein-protein interactions", Trends in Genetics, 10 (8):286-292, 1994.

Fleischmann et al., Accession No. P43719, Swissprot database Nov. 1, 1995.

Fleischmann et al., "Whole-Genome Random Sequencing and Assembly of *Haemophilus influenzae* Rd", Science, 269(5223):496-512, 1995.

Foster, "*Salmonella* Acid Shock Proteins Are Required for the Adaptive Acid Tolerance Response", Journal of Bacteriology, 173(21):6896-6902, 1991.

Fuller et al., "Identification of *Actinobacillus pleuropneumoniae* virulence genes using signature-tagged mutagenesis in a swine infection model", Microbial Pathogenesis, 29(1):39-51, 2000.

Fuller et al., "Identification of in vivo induced genes in *Actinobacillus pleuropneumoniae*", Microbial Pathogenesis, 27(5):311-327, 1999.

Garcia-Del Portillo et al., "Role of Acid Tolerance Response Genes in *Salmonella typhimurium* Virulence", Infection and Immunity, 61(10):4489-4492, 1993.

Gibson and Shillitoe, "Ribozymes—Their Functions and Strategies for Their Use", Mol. Biotechnol., 7(2):125-137, 1997.

Göthel et al., "Cyclophilin and Trigger Factor from *Bacillus subtilis* Catalyze in Vitro Protein Folding and Are Necessary for Viability under Starvation Conditions", Biochemistry, 37(38):13392-13399, 1998.

Gray et al., "Mutation of the miaA Gene of *Agrobacterium tumefaciens* Results in Reduced vir Gene Expression", Journal of Bacteriology, 174(4):1086-1098, 1992.

Grosjean and Fiers, "Preferential codon usage in prokaryotic genes: the optimal codon-anticodon interaction energy and the selective codon usage in efficiently expressed genes", Gene, 18:199-209, 1982.

Guthrie and Wickner, "Trigger Factor Depletion or Overproduction Causes Defective Cell Division but Does Not Block Protein Export", Journal of Bacteriology, 172(10):5555-5562, 1990.

Gwinn et al., "In Vitro Tn7 Mutagenesis of *Haemophilus influenzae* Rd and Characterization of the Role of atpA in Transformation", Journal of Bacteriology, 179(23):7315-7320, 1997.

Hanawa et al., "*Listeria monocytogenes* Can Grow in Macrophages without the Aid of Proteins Induced by Environmental Stresses", Infection and Immunity, 63(12):4595-4599, 1995.

Hantke and Zimmermann, "The Importance of the exbB gene for vitamin B12 and ferric iron transport", FEMS Microbiology Letters, 49:31-35, 1981.

Harlow et al. (eds.), "Monoclonal Antibodies", Antibodies a Laboratory Manual; Cold Spring Harbor Laboratory; Cold Spring Harbor, NY, Chapter 6, pp. 141-243, 1988.

Herrero et al., "Transposon Vectors Containing Non-Antibiotic Resistance Selection Markers for Cloning and Stable Chromosomal Insertion of Foreign Genes in Gram-Negative Bacteria", Journal of Bacteriology, 172(11):6557-6567, 1990.

Hesterkamp and Bukau, "The *Escherichia coli* trigger factor", FEBS Letters, 389:32-34, 1996.

Hesterkamp et al., "*Escherichia coli* trigger factor is a prolyl isomerase that associates with nascent polypeptide chains", Proc. Natl. Acad. Sci. USA, 93(9):4437-4441, 1996.

Hopp et al., "A short polypeptide marker sequence useful for recombinant protein identification and purification", Biotechnology, 6:1205-1210, 1988.

Horne and Young, "*Escherichia coli* and other species of the *Enterobacteriaceae* encode a protein similar to the family of Mip-like FK506-binding proteins", Archives of Microbiology, 163(5):357-365, 1995.

Horne et al., "Decreased Intracellular Survival of an fkpA Mutant of *Salmonella typhimurium* Copenhagen", Infection and Immunity, 65(2):806-810, 1997.

Hromockyj et al., "Temperature regulation of *Shigella* virulence: identification of the repressor gene virR, an analogue of hns, and partial complementation by tyrosyl transfer RNA (tRNA1Tyr)", Molecular Microbiology, 6 (15):2113-2124, 1992.

Huisman et al., "Multiple Defects in *Escherichia coli* Mutants Lacking HU Protein", Journal of Bacteriology, 171 (7):3704-3712, 1989.

Inzana et al., "Safety, Stability, and Efficacy of Noncapsulated Mutants of *Actinobacillus pleuropneumoniae* for Use in Live Vaccines", Infection and Immunity, 61(5):1682-1686, 1993.

Jahn et al., "Glutamyl-transfer RNA: a precursor of heme and chlorophyll biosynthesis", Trends Biochem Sci, 17:215-218, 1992.

Kang and Craig, "Identification and Characterization of a New *Escherichia coli* Gene That Is a Dosage-Dependent Suppressor of a dnaK Deletion Mutation", Journal of Bacteriology, 172(4):2055-2064, 1990.

Karlsson et al., "ExbB acts as a chaperone-like protein to stabilize TonB in the cytoplasm", Molecular Microbiology, 8(2):389-396, 1993.

Karlsson et al., "A sequence-specific function for the N-terminal signal-like sequence of the TonB protein", Molecular Microbiology, 8(2):379-388, 1993.

Kashiwagi et al., "Functions of PotA and PotD Proteins in Spermidine-preferential Uptake System in *Escherichia coli*", J. Biol. Chem., 268(26):19358-19363, 1993.

Köhler et al., "Participation of the molecular chaperone DnaK in intracellular growth of *Brucella suis* within U937-derived phagocytes", Molecular Microbiology, 20(4):701-712, 1996.

Konigsberg and Godson, "Evidence for use of rare codons in the dnaG gene and other regulatory genes of *Escherichia coli*", Proc. Natl. Acad. Sci. USA, 80(3):687-691, 1983.

Lavallie et al., "A Thioredoxin Gene Fusion Expression System That Circumvents Inclusion Body Formation in the *E. coli* Cytoplasm", Bio/Technology, 11:187-193, 1993.

Lavrovsky et al., "Therapeutic Potential and Mechanism of Action of Oligonucleotides and Ribozymes", Biochem. Mol. Med., 62(1):11-22, 1997.

Lee and Henk, "Tn10 insertional mutagenesis in *Pasteurella multocida*", Veterinary Microbiology, 50(1-2):143-148, 1996.

Lehninger, "The Molecular Basis of Cell Structure and Function", Biochemistry, Second Edition, Worth Publishers, Inc., NY:NY, Chapter 4, pp. 71-94, 1975.

Leibowitz and Soffer, "A soluble enzyme from *Escherichia coli* which catalyzes the transfer of leucine and phenylalanine from tRNA to acceptor proteins", Biochem Biophys Res Commun, 36(1):47-53, 1969.

Lindquist and Craig, "The Heat-Shock Proteins", Annu. Rev. Genet, 22:631-677, 1988.

Lyon et al., "A role for Trigger Factor and an Rgg-like receptor in the transcription, secretion and processing of the cysteine proteinase of *Streptococcus pyogenes*", The EMBO Journal, 17(21):6263-6275, 1998.

Mei et al., "Identification of *Staphylococcus aureus* virulence genes in a murine model of bacteraemia using signature-tagged mutagenesis", Molecular Microbiology, 26(2):399-407, 1997.

Missiakas et al., "New components of protein folding in extracytoplasmic compartments of *Escherichia coli* SurA, FkpA and Skp/OmpH", Molecular Microbiology, 21(4):871-884, 1996.

Miyamoto and Bakaletz, "Selective adherence of non-typeable *Haemophilus influenzae* (NTHi) to mucus or epithelial cells in the chinchilla Eustachian tube and middle ear", Microbial Pathogenesis, 21(5):343-356, 1996.

Mukkur, "Demonstration of Cross-Protection Between *Pasteurella multocida* Type A and *Pasteurella haemolytica*, Serotype 1", Infection and Immunity, 18(3):583-585, 1977.

Mulks and Buysse, "A targeted mutagenesis system for *Actinobacillus pleuropneumoniae*", Gene, 165(1):61-66, 1995.

Munson et al., "Molecular Cloning and Sequence of the Gene for Outer Membrane Protein P5 of *Haemophilus influenzae*", Infection and Immunity, 61(9):4017-4020, 1993.

Myers, "Will combinatorial chemistry deliver real medicines?", Current Opinion in Biotechnology, 8(6):701-707, 1997.

Nielsen, "*Haemophilus parahaemolyticus* Serotypes Pathogenicity and Cross Immunity", Nord. Vet-Med., 31 (10):407-413, 1979.

Nielsen, "*Haemophilus pleuropneumoniae* Serotypes—Cross Protection Experiments", Nord. Vet.-Med., 36 (7-8):221-234, 1984.

Nielsen, "Seroepidemiology of *Actinobacillus pleuropneumoniae*", Can. Vet. J., 29:580-582, 1988.

Nielsen, "Serological and Immunological Studies of Pleuropneumonia of Swine Caused by *Haemophilus parahaemolyticus*", Acta. Vet. Scand., 15(1):80-89, 1994.

Occhino et al., "*Vibrio cholerae* iron transport: haem transport genes are linked to one of two sets of tonB, exbB, exbD genes", Molecular Microbiology, 29(6):1493-1507, 1998.

Palmer et al., "The Repressor Protein, Bm3R1, Mediates an Adaptive Response to Toxic Fatty Acids in *Bacillus megaterium*", J. Biol. Chem., 273(29):18109-18116, 1998.

Paltineanu et al., "Swine Infectious *Pleuropneumonia*: Aerosol Vaccination with a Live Attenuated Vaccine", International Pig Veterinary Society, p. 214, 1992.

Panciera and Corstvet, "Bovine pneumonic pasteurellosis: Model for *Pasteurella haemolytica*- and *Pasteurella multocida*-induced pneumonia in cattle", Am. J. Vet. Res., 45(12):2532-2537, 1984.

Pandher and Murphy, "Genetic and immunological analyses of a 38 kDa surface-exposed lipoprotein of *Pasteurella haemolytica* A1", Vet. Microbiol., 51(3-4):331-341, 1996.

PCT International Search Report, PCT/US00/09218, mailed Oct. 24, 2000.

Prideaux et al., "Vaccination and Protection of Pigs against *Pleuropneumonia* with a Vaccine Strain of *Actinobacillus pleuropneumoniae* Produced by Site-Specific Mutagenesis of the ApxII Operon", Infection and Immunity, 67 (4):1962-1966, 1999.

Polissi et al., "Large-Scale Identification of Virulence Genes from *Streptococcus pneumoniae*", Infection and Immunity, 66(12):5620-5629, 1998.

Qi et al., "*Salmonella typhimurium* responses to a bactericidal protein from humen neutrophils", Molecular Microbiology, 170:523-531, 1995.

Reddy et al., "Binding between Outer Membrane Proteins of Nontypeable *Haemophilus influenzae* and Human Nasopharyngeal Mucin", Infection and Immunity, 64(4):1477-1479, 1996.

Reyrat et al., "Counterselectable Markers: Untapped Tools for Bacterial Genetics and Pathogenesis", Infection and Immunity, 66(9):4011-4017, 1998.

Rich and Willis, "Multiple Loci of *Pseudomonas syringae* pv. *syringae* Are Involved in Pathogenicity on Bean: Restoration of One Lesion-Deficient Mutant Requires Two tRNA Genes", J. Bacteriol., 179(7):2247-2258, 1997.

Rimler and Rhoades, "Lysates of Turkey-Grown *Pasteurella multocida*: Protection Against Homologous and Heterologous Serotype Challenge Exposures", Am. J. Vet. Res. 42(12):2117-2121, 1981.

Ritter et al., "tRNA genes and pathogenicity islands: influence on virulence and metabolic properties of uropathogenic *Escherichia coli*", Molecular Microbiology, 17(1):109-121, 1995.

Sambrook et al. (eds.), "Hybridization of Radiolabeled Probes to Immobilized Nucleic Acids", Molecular Cloning: A Laboratory Manual, Cold Spring Harbor Laboratory Press: Cold Spring Harbor, NY, pp. 9.47 to 9.51, 1989.

Schlink and Olson, "Effects of Bursectomy, Irradiation, and Cyclophosphamide on Turkeys Vaccinated with CU Cholera Strain", Avian Dis., 31(1):13-21, 1987.

Shewen and Conlon, "*Pasteurella*", Pathogenesis of Bacterial Infections in Animals, Gyles and Thoen (ed.), Iowa State University Press, Ames, Iowa, pp. 216-225, 1993.

Sirakova et al., "Role of Fimbriae Expressed by Nontypeable *Haemophilus influenzae* in Pathogenesis of and Protection against Otitis Media and Relatedness of the Fimbrin Subunit to Outer Membrane Protein A", Infection and Immunity, 62(5):2002-2020, 1994.

Schmidt and Skerra, "The random peptide library-assisted engineering of a C-terminal affinity peptide, useful for the detection and purification of a functional Ig Fv fragment", Protein Eng., 6(1):109-122, 1993.

Smith and Johnson, "Single-step purification of polypeptides expressed in *Escherichia coli* as fusions with glutathione S-transferase", Gene, 67(1):31-40, 1988.

Stewart et al., "Novel Species of tRNA", Nature, 230(5288):36-38, 1971.

Stojiljkovic and Srinivasan, "*Neisseria meningitidis* tonB, exbB, and exbD Genes: Ton-Dependent Utilization of Protein-Bound Iron in *Neisseriae*", J. Bacteriol., 179(3):805-812, 1997.

Stoller et al., "A ribosome-associated peptidyl-prolyl cis/trans isomerase identified as the trigger factor", The EMBO Journal, 14(20):4939-4948, 1995.

Tascon et al., "Transposon Mutagenesis in *Actinobacillus pleuropneumoniae* with a Tn10 Derivative", Journal of Bacteriology, 175(17):5717-5722, 1993.

Tascon et al., "The RTX haemolysins ApxI and ApII are major virulence factors of the swine pathogen *Actinobacillus pleuropneumoniae*: evidence from mutational analysis", Molecular Microbiology, 14(2):207-216, 1994.

Tobe et al., "vacB, a Novel Chromosomal Gene Required for Expression of Virulence Genes on the Large Plasmid of *Shigella flexneri*", J. Bacteriol., 174(20):6359-6367, 1992.

Tobias et al., "The N-End Rule in Bacteria", Science, 254(5036):1374-1377, 1991.

Turner et al., "Identification of *Salmonella typhimurium* Genes Required for Colonization of the Chicken Alimentary Tract and for Virulence in Newly Hatched Chicks", Infection and Immunity, 66(5):2099-2106, 1998.

Utrera et al., "Evaluation of the Immunity Induced in Pigs After Infection with a Low Virulence Strain of *A. pleurophneumoniae* Serotype I", International Pig Veterinary Society, p. 213, 1992.

Wada et al., "Construction and Characterization of the Deletion Mutant of hupA and hupB Genes in *Escherichia coli*", J. Mol. Biol., 204(3):581-591, 1988.

Wada et al., "Participation of the hup gene product in site-specific DNA inversion in *Escherichia coli*", Gene, 76 (2):345-352, 1989.

Wang and Bechhofer, "Properties of a *Bacillus subtilis* Polynucleotide Phosphorylase Deletion Strain", J. Bacteriol., 178(8):2375-2382, 1996.

Wieboldt et al., "Immunoaffinity Ultrafiltration with Ion Spray HPLC/MS for Screening Small-Molecule Libraries", Anal. Chem., 69:1683-1691, 1997.

Wilson, "Preparation of Genomic DNA from Bacteria", Current Protocols in Molecular Biology, Ausubel et al., (eds.), vol. 1, John Wiley and Sons, New York, pp. 2.4.1-2.4.5, 1997.

Yamamoto et al., "Induction of *Yersinia enterocolitica* Stress Proteins by Phagocytosis with Macrophage", Microbiology and Immunology, 38(4):295-300, 1994.

Zhang and Cronan, "Transcriptional Analysis of Essential Genes of the *Escherichia coli* Fatty Acid Biosynthesis Gene Cluster by Functional Replacement with the Analogous *Salmonella typhimurium* Gene Cluster", Journal of Bacteriology, 180(13):3295-3303, 1998.

Macinnes and Smart, "*Actinobacillus* and *Haemophilus*", Pathogenesis of Bacterial Infections in Animals, 2nd edition, Gyles and Thoen (eds.), Iowa State University Press, Ames, Iowa, pp. 188-200, 1993.

Fedorova and Highlander, "Generation of Targeted Nonpolar Gene Insertions and Operon Fusions in *Pasteurella haemolytica* and Creation of a Strain That Produces and Secretes Inactive Leukotoxin", Infection and Immunity, 65(7):2593-2598, 1997.

Swiss-Prot accession No. P43716, *Haemophilus influenzae* ATP synthase gamma subunit, submitted Nov. 1995.

Henderson, "Macromolecular structure and self-assembly", Novartis Foundation Symposium, 213:36-55, 1998.

Omote and Futai, "Mutational Analysis of F1F0 ATPase: Catalysis and Energy Coupling", ACTA Physiol. Scand., 163(Suppl. 654):177-183, 1998.

Kooistra et al., "Genetics and Complementation of *Haemophilus influenzae* Mutants Deficient in Adenosine 5'-Triphosphate-Dependent Nuclease", Journal of Bacteriology, 126(1):31-37, 1976.

Rahlfs et al., "The Na+-F1F0-ATPase Operon from *Acetobacterium woodii*", The Journal of Biological Chemistry, 274(48):33999-34004, 1999.

Bernstein et al., "Restriction fragment mapping of nontypable *Haemophilus influenzae*: A new tool to study this middle ear pathogen", Otolaryngol. Head Neck Surg., 100(3):200-6, 1989.

Blackall et al., "Comparison of *Haemophilus paragallinarum* isolates by restriction endonuclease analysis of chromosomal DNA", Veterinary Microbiology, 27(1):39-47, 1991.

Butler and Moxon, "A physical map of the genome of *Haemophilus influenzae* type b", Journal of General Microbiology, 136(12):2333-2342, 1990.

Chevallier et al., "Chromosome sizes and phylogenetic relationships between serotypes of *Actinobacillus pleuropneumoniae*", FEMS Microbiology Letters, 160(2):209-216, 1998.

Hobbs et al., "Organization of the *Haemophilus ducreyi* 35000 chromosome", Microbiology, 142(Pt. 9):2587-2594, 1996.

Kroll et al., "Natural genetic exchange between *Haemophilus* and *Neisseria*: Intergeneric transfer of chromosomal genes between major human pathogens", Proc. Natl. Acad. Sci USA, 95(12):12381-12385, 1998.

Slots et al., "Evaluating two methods for fingerprinting genomes of *Actinobacillus actinomycetemcomitans*", Oral Microbiology and Immunology, 8(6):337-343, 1993.

Valcarcel et al., "Investigation of the *Actinobacillus actinomycetemcomitans* genome by pulsed field gel electrophoresis", Oral Microbiology and Immunology, 12(1):33-39, 1997.

Fuller et al., "Identification of *Pasteurella multocida* virulence genes in a septicemic mouse model using signature-tagged mutagenesis", Microb. Pathog., 29(1):25-38, 2000.

May et al., "Complete genomic sequence of *Pasteurella multocida*, Pm70", Proc. Natl. Acad. Sci USA, 98 (6):3460-3465, 2001.

Oswald et al., "First Chromosomal Restriction Map of *Actinobacillus pleuropneumoniae* and Localization of Putative Virulence-Associated Genes", Journal of Bacteriology, 181(14):4161-4169, 1999.

Accession No. AF032869, Nov. 24, 1997, *Actinobacillus pleuropneumoniae* ATP synthase gene, partial cds., Bacmeister, Cx et al.

Accession No. AE006185, Oct. 24, 2000, May et al., *Pasteurella multocida* complete genome sequence.

Accession No. AF237922, Feb. 24, 2000, Fuller et al., *Pasteurella multocida* ATP synthase F1-gamma chain gene.

Borghese et al., "The ATP Synthase atpHAGDC (F1) Operon from *Rhodobacter capsulatus*", Journal of Bacteriology, 180(2):416-421, 1998.

Cameron and Bester, "Response of Sheep and Cattle to Combined Polyvalent *Pasteurella haemolytica* Vaccines", Onderstepoort J. Vet. Res., 53(1):1-7, 1986.

Chandrasekaran et al., "Evaluation of Combined *Pasteurella* Vaccines in Control of Sheep Pneumonia", British Veterinary Journal, 147(5):437-443, 1991.

Chen et al., "Suppression of p0 lethality by mitochondrial ATP synthase F1 mutations in *Kluyveromyces lactis* occurs in the absence of F0", Molecular and General Genetics, 259(5):457-467, 1998.

Confer et al., "Effect of vaccination with live or killed *Pasteurella haemolytica* on resistance to experimental bovine pneumonic pasteurellosis", Am. J. Vet. Res., 46(2):342-347, 1985.

Humbert and Altendorf, "Defective gamma Subunit of ATP Synthase (F1F0) from *Escherichia coli* Leads to Resistance to Aminoglycoside Antibiotics", Journal of Bacteriology, 171(3):1435-1444, 1989.

Iwamoto et al., "H+-ATPase gamma Subunit of *Escherichia coli*", The Journal of Biological Chemistry, 265 (9):5043-5048, 1990.

Jones et al., "Attempt to Prevent the Effects of Experimental Chronic Pneumonia in Sheep by Vaccination Against *Pasteurella haemolytica*", British Veterinary Journal, 142(2):189-194, 1986.

Kaim and Dimroth, "A Double Mutation in Subunit c of the Na+-specific F1F0-ATPase of *Propiongenium modestum* Results in a Switch from Na+ to H+-coupled ATP Synthesis in the *Escherichia coli* Host Cells", Journal of Molecular Biology, 253(5):726-738, 1995.

Nakamoto et al., "The gamma Subunit of the *Escherichia coli* ATP Synthase", Journal of Biological Chemistry, 268 (2):867-872, 1993.

Zeman et al., "Systemic *Pasteurella haemolytica* infection as a rare sequel to avirulent live *Pasteurella haemolytica* vaccination in cattle", Journal of Veterinary Diagnostic Investigation, 5(4):555-559, 1993.

Fillingame et al., "Synthesis of a Functional F0 Sector of the *Escherichia coli* H+-ATPase Does Not Require Synthesis of the Alpha or Beta Subunits of F1", J. Bacteriol., 165(1):244-251, 1986.

* cited by examiner

ATTENUATED YIAO MUTANTS OF PASTEURELLACEAE BACTERIA

This application is a continuation application of U.S. patent application Ser. No. 11/251,464, filed Oct. 14, 2005, now abandoned, which is a continuation application of U.S. patent application Ser. No. 09/545,199, filed Apr. 6, 2000, now abandoned, which in turn claims benefit under 35 U.S.C. 119 of U.S. Provisional Application Ser. No. 60/153,453, filed Sep. 10, 1999, and U.S. Provisional Application Ser. No. 60/128,689, filed Apr. 9, 1999, which are incorporated herein by reference.

FIELD OF THE INVENTION

The present invention relates generally to the identification of genes responsible for virulence of *Pasteurella multocida* and *Actinobacillus pleuropneumoniae* bacteria, thereby allowing for production of novel attenuated mutant strains useful in vaccines and identification of new anti-bacterial agents that target the virulence genes and their products.

BACKGROUND OF THE INVENTION

The family *Pasteurellaceae* encompasses several significant pathogens that infect a wide variety of animals. In addition to *P. multocida*, prominent members of the family include *Pasteurella haemolytica, Actinobacillus pleuropneumoniae* and *Haemophilus somnus. P. multocida* is a gram-negative, nonmotile coccobacillus which is found in the normal flora of many wild and domestic animals and is known to cause disease in numerous animal species worldwide [Biberstein, In M. Kilian, W. Frederickson, and E. L. Biberstein (ed.), *Haemophilus, Pasteurella*, and *Actinobacillus*. Academic Press, London, p. 61-73 (1981)]. The disease manifestations following infection include septicemias, bronchopneumonias, rhinitis, and wound infections [Reviewed in Shewen, et al., In C. L. Gyles and C. O. Thoen (ed.), *Pathogenesis of Bacterial Infections in Animals*. Iowa State University Press, Ames, p. 216-225 (1993), incorporated herein by reference].

Infection by *P. multocida* generally results from invasion during periods of stress, but transmission may also occur by aerosol or contact exposure, or via flea and tick vectors. In fowl, *P. multocida* infection gives rise to acute to peracute septicemia, particularly prevalent in domestic turkeys and wild waterfowl under stress conditions associated with overcrowding, laying, molting, or severe climatic change. In cattle, a similar hemorrhagic septicemia follows infection and manifests conditions including high fever and depression, generally followed by quick death. Transmission is most likely through aerosol contact, but infection can also arise during periods of significant climatic change. In rabbits, infection gives rise to recurring purulent rhinitis, generally followed by conjunctivitis, otitis media, sinusitis, subcutaneous abscesses, and chronic bronchopneumonia. In severe infections, rabbit mortality arises from acute fibrinous bronchopneumonia, septicemia, or endotoxemia. Disease states normally arise during periods of stress. In pigs, common *P. multocida* disease states include atrophic rhinitis and bacterial pneumonia. Similar pneumonia conditions are also detected in dogs, cats, goats, and sheep. *P. multocida* is commonly detected in oral flora of many animals and is therefore a common contaminant in bite and scratch wounds.

*P. multocida* strains are normally designated by capsular serogroup and somatic serotype. Five capsular serogroups (A, B, D, E, and F) and 16 somatic serotypes are distinguished by expression of characteristic heat-stable antigens. Most strains are host specific and rarely infect more than one or two animals. The existence of different serotypes presents a problem for vaccination because traditional killed whole cell bacteria normally provide only serotype-specific protection. However, it has been demonstrated that natural infection with one serotype can lead to immunological protection against multiple serotypes [Shewen, et al., In C. L. Gyles and C. O. Thoen (Ed.), *Pathogenesis of Bacterial Infections in Animals*. Iowa State University Press, Ames, p. 216-225 (1993)] and cross protection can also be stimulated by using inactivated bacteria grown in vivo [Rimler, et al., *Am J Vet Res.* 42:2117-2121 (1981)]. One live spontaneous mutant *P. multocida* strain has been utilized as a vaccine and has been shown to stimulate a strong immune response [Davis, *Poultry Digest.* 20:430-434 (1987), Schlink, et al., *Avian Dis.* 31(1): 13-21 (1987)]. This attenuated strain, however, has been shown to revert to a virulent state or cause mortality if the vaccine recipient is stressed [Davis, *Poultry Digest.* 20:430-434 (1987), Schlink, et al., *Avian Dis.* 31(1):13-21 (1987)).

Another member of the Pasteurella family, *A. pleuropneumoniae* exhibits strict host specificity for swine and is the causative agent of highly contagious porcine pleuropneumonia. Infection normally arises in intensive breeding conditions, and is believed to occur by a direct mode of transmission. The disease is often fatal and, as a result, leads to severe economic loss in the swine producing industry. *A. pleuropneumoniae* infection may be chronic or acute, and infection is characterized by a hemorrhagic, necrotic bronchopneumonia with accompanying fibrinous pleuritis. To date, bacterial virulence has been attributed to structural proteins, including serotype-specific capsular polysaccharides, lipopolysaccharides, and surface proteins, as well as extracellular cytolytic toxins. Despite purification and, in some instances cloning, of these virulence factors, the exact role of these virulence factors in *A. pleuropneumoniae* infection is poorly understood.

Twelve serotypes of *A. pleuropneumoniae* have been identified based on antigenic differences in capsular polysaccharides and production of extracellular toxins. Serotypes 1, 5, and 7 are most relevant to *A. pleuropneumoniae* infection in the United States, while serotypes 1, 2, 5, 7, and 9 are predominant in Europe. There are at least three significant extracellular toxins of *A. pleuropneumoniae* that are members of the haemolysin family and are referred to as RTX toxins. RTX toxins are produced by many Gram negative bacteria, including *E. coli, Proteus vulgarisa*, and *Pasteurella haemolytica*, and the proteins generally share structural and functional characteristics. Toxins from the various serotypes differ, however, in host specificity, target cells, and biological activities.

The major *A. pleuropneumoniae* RTX toxins include ApxI, ApxII, and ApxIII. ApxI and ApxII have haemolytic activity, with ApxI being more potent. ApxIII shows no haemolytic activity, but is cytotoxic for alveolar macrophages and neutrophils. Most *A. pleuropneumoniae* serotypes produce two of these three toxins. For example, serotypes 1, 5, 9, and 11 express ApxI and ApxII, and serotypes 2, 3, 4, 6, and 8 express ApxII and ApxIII. Serotype 10, however, produces only ApxI, and serotypes 7 and 12 express only ApxII. Those *A. pleuropneumoniae* serotypes that produce both ApxI and ApxII are the most virulent strains of the bacteria.

The Apx toxins were demonstrated to be virulence factors in murine models and swine infection using randomly mutated wild type bacteria [Tascon, et al., *Mol. Microbiol.* 14:207-216 (1994)]. Other *A. pleuropneumoniae* mutants have also been generated with targeted mutagenesis to inactivate the gene encoding the AopA outer membrane virulence protein [Mulks and Buysee, *Gene* 165:61-66 (1995)].

In attempts to produce vaccine compositions, traditional killed whole cell bacteria have provided only serotype-specific protection [MacInnes and Smart, supra], however, it has been demonstrated that natural infection with a highly virulent serotype can stimulate strong protective immunity against multiple serotypes [Nielsen, *Nord Vet Med.* 31:407-13 (1979), Nielsen, *Nord Vet Med.* 36:221-234 (1984), Nielsen, *Can J Vet Res.* 29:580-582 (1988), Nielsen, *ACTA Vet Scand.* 15:80-89 (1994)). One defined live-attenuated vaccine strain producing an inactive form of the ApxII toxin has shown promise for cross protection in swine [Prideaux, et al., *Infection & Immunity* 67:1962-1966 (1999)], while other undefined live-attenuated mutants have also shown promise [Inzana, et al., *Infect Immun.* 61:1682-6, (1993), Paltineanu, et al., *In International Pig Veterinary Society,* 1992, p. 214, Utrera, et al., *In International Pig Veterinary Society,* 1992, p. 213].

Because of the problems associated with vaccine formulations comprising bacterial strains with undefined, spontaneous mutations, there exists a need in the art for rational construction of live attenuated bacterial strains for use in vaccines that will safely stimulate protective immunity against homologous and heterologous *P. multocida* and *A. pleuropneumoniae* serotypes. There further exists a need to identify attenuated bacterial strains and genes required for bacterial virulence, thereby facilitating development of methods to identify anti-bacterial agents.

SUMMARY OF THE INVENTION

In general, the present invention provides materials and methods for production and use of vaccine compositions comprising attenuated gram negative bacteria. In one aspect, vaccine compositions of the invention comprise attenuated species in the Pasteurellaceae family of bacteria, which is known in the art and described, in part, in Dewhirst, et al., *J. Bacteriol.* 174:2002-2013 (1992), incorporated herein by reference in its entirety. Species in the family include, but are not limited to, *A. actinomycetemcomitans, A. capsulatus, A. equuli, A. lignieresii, A. pleuropneumoniae (H. pleuropneumoniae), A. seminis, A. suis (H. suis), A. ureae (p. ureae), A. capsulatus, Bisgaard* taxon 11, *H. aegyptius, H. aphrophilus, H. aphrophilus (H. parainfluenzae), H. ducreyi, H. haemoglobinophilus, H. haemolyticus, H. influenzae, H. paracuniculus, H. paragallinarum, H. parahaemolyticus, H. parainfluenzae, (H. paraphrophilus), H. paraphrohaemolyticus, H. paraphrophilus, H. parasuis, H. parasuis* type 5, *H. segnis, H. somnus, Haemophilus* minor group, *Haemophilus* taxon C, *P. aerogenes, P. anatis, P. avium (H. avium), P. canis, P. dagmatis, P. gallinarum, P. haemolytica, P. trehalosi (P. haemolytica* biotype T), *P. langaa, P. multocida, P. pneumotropica, P. stomatis, P. volantium (H. parainfluenzae), P. volantium, Pasteurella* species A, *Pasteurella* species B, and *Haemophilus paraphrohaemolyticus*. Preferably, vaccine compositions comprise attenuated *Pasteurella haemolytica, Actinobacillus pleuropneumoniae, Haemophilus somnus,* or *Pasteurella multocida* bacteria. In a most preferred embodiment, vaccine compositions of the invention comprise attenuated *Pasteurella multocida* and *A. plueropneumoniae* bacterial strains.

One aspect of the invention provides gram negative bacterial organisms containing a functional mutation in a gene sequence represented by any one of SEQ ID NOS: 1, 3, 7, 9, 11, 13, 15, 17, 19, 21, 23, 25, 29, 31, 33, 37, 39, 41, 51, 53, 55, 57, 58, 60, 68, 70, 72, 74, 76, 78, 80, 82, 84, 100, 102, 104, 106, 108, 110, 112, 114, 116, 118, 120, 122, 124, 126, 128, 130, 132, 134, 135, 136, 138, 140, 142, 144, 146, 148, 150, 152, 154, 156, 158, 160, 162, 163, and 164, or species homologs thereof, wherein the mutation inhibits or abolishes expression and/or biological activity of an encoded gene product (i.e., the polypeptide encoded by a gene); said functional mutation resulting in attenuated virulence of the bacterial strain. As understood in the art, species homologs include genes found in two or more different species which possess substantial polynucleotide sequence homology and possess the same, or similar, biological functions and/or properties. Preferably polynucleotide sequences which represent species homologs will hybridize under moderately stringent conditions, as described herein by example, and possess the same or similar biological activities and or properties. In another aspect, polynucleotides representing species homologs will share greater than about 60% sequence homology, greater than about 70% sequence homology, greater than about 80% sequence homology, greater than about 90% sequence homology or greater than about 95% sequence homology. Functional mutations that modulate (i.e., increase or decrease) expression and/or biological activity of a gene product include insertions or deletions in the protein coding region of the gene itself or in sequences responsible for, or involved in, control of gene expression. Deletion mutants include those wherein all or part of a specific gene sequence is deleted. In one aspect, the mutation results in deletion of at least about 10%, at least about 20%, at least about 30%, at least about 40% at least about 50%, at least about 60%, at least about 70%, at least about 80%, at least about 90%, at least about 95%, at least about. 98%, or at least about 99% of said gene. In another aspect, the mutation results in an insertion in the gene, wherein the insertion causes decreased expression of a gene product encoded by the mutated gene and/or expression of an inactive gene product encoded by the mutated gene. Also contemplated are compositions, and preferably vaccine compositions, comprising mutated and attenuated gram negative bacterial organisms, optionally comprising a suitable adjuvant and/or a pharmaceutically acceptable diluent or carrier. In order for a modified strain to be effective in a vaccine formulation, the attenuation must be significant enough to prevent the pathogen from evoking severe clinical symptoms, but also insignificant enough to allow limited replication and growth of the bacteria in the host.

The invention also provides polynucleotides encoding gene products that are required for virulence in gram negative bacteria. Polynucleotides of the invention include DNA, such as complementary DNA, genomic DNA including complementary or anti-sense DNA, and wholly or partially synthesized DNA; RNA, including sense and antisense strands; and peptide nucleic acids as described, for example in Corey, *TIBTECH* 15:224-229 (1997). Virulence gene polynucleotides of the invention include those set forth in SEQ ID NOs:1, 3, 7, 9, 11, 13, 15, 17, 19, 21, 23, 25, 29, 31, 33, 37, 39, 41, 51, 53, 55, 57, 58, 60, 68, 70, 72, 74, 76, 78, 80, 82, 84, 100, 102, 104, 106, 108, 110, 112, 114, 116, 118, 120, 122, 124, 126, 128, 130, 132, 134, 135, 136, 138, 140, 142, 144, 146, 148, 150, 152, 154, 156, 158, 160, 162, 163, and 164, or species homologs thereof, polynucleotides encoding a virulence gene product encoded by a polynucleotide of SEQ ID NOs: 1, 3, 7, 9, 11, 13, 15, 17, 19, 21, 23, 25, 29, 31, 33, 37, 39, 41, 51, 53, 55, 57, 58, 60, 68, 70, 72, 74, 76, 78, 80, 82, 84, 100, 102, 104, 106, 108, 110, 112, 114, 116, 118, 120, 122, 124, 126, 128, 130, 132, 134, 135, 136, 138, 140, 142, 144, 146, 148, 150, 152, 154, 156, 158, 160, 162, 163, and 164, or a species homolog thereof, and polynucleotide that hybridize, under moderately to highly stringent conditions, to the non-coding strand (or complement) of any one of the polynucleotides set out in SEQ ID NOs: 1, 3, 7, 9, 11, 13, 15, 17, 19, 21, 23, 25, 29, 31, 33, 37, 39, 41, 51, 53, 55, 57, 58, 60, 68, 70, 72, 74, 76, 78, 80, 82, 84, 100, 102, 104, 106, 108, 110, 112, 114, 116, 118, 120, 122, 124, 126, 128, 130, 132, 134, 135, 136, 138, 140, 142, 144, 146, 148, 150, 152, 154, 156, 158, 160, 162, 163, and 164, species homologs thereof. The invention therefore comprehends gene sequences from Pasteurellaceae set out in SEQ ID NOs: 1, 3, 7, 9, 11, 13, 15, 17, 19, 21, 23, 25, 29, 31, 33, 37, 39, 41, 51, 53, 55, 57, 58, 60, 68, 70, 72, 74, 76, 78, 80, 82, 84, 100, 102, 104, 106, 108, 110, 112, 114, 116, 118, 120, 122, 124, 126, 128, 130, 132, 134, 135, 136, 138, 140, 142, 144, 146, 148, 150, 152, 154, 156, 158, 160, 162, 163, and 164, as well as related gene sequences from other gram negative bacterial organisms, including naturally occurring (i.e., species homologs) and artificially induced variants thereof. The invention also comprehends polynucleotides which encode polypeptides deduced from any one of the polynucleotides set out in SEQ ID NOs: 1, 3, 7, 9, 11, 13, 15, 17, 19, 21, 23, 25, 29, 31, 33, 37, 39, 41, 51, 53, 55, 57, 58, 60, 68, 70, 72, 74, 76, 78, 80, 82, 84, 100, 102, 104, 106, 108, 110, 112, 114, 116, 118, 120, 122, 124, 126, 128, 130, 132, 134, 135, 136, 138, 140, 142, 144, 146, 148, 150, 152, 154, 156, 158, 160, and 164, and species homologs thereof. Knowledge of the sequence of a polynucleotide of the invention makes readily available every possible fragment of that polynucleotide. The invention therefore provides fragments of a polynucleotide of the invention.

The invention further embraces expression constructs comprising polynucleotides of the invention. Host cells transformed, transfected or electroporated with a polynucleotide of the invention are also contemplated. The invention provides methods to produce a polypeptide encoded by a polynucleotide of the invention comprising the steps of growing a host cell of the invention under conditions that permit, and preferably promote, expression of a gene product encoded by the polynucleotide, and isolating the gene product from the host cell or the medium of its growth.

Identification of polynucleotides of the invention makes available the encoded polypeptides. Polypeptides of the invention include full length and fragment, or truncated, proteins; variants thereof, fusion, or chimeric proteins; and analogs, including those wherein conservative amino acid substitutions have been introduced into wild-type polypeptides. Antibodies that specifically recognize polypeptides of the invention are also provided, and include monoclonal and polyclonal antibodies, single chain antibodies, chimeric antibodies, humanized antibodies, human antibodies, and complementary determining region (CDR)-grafted antibodies, as well as compounds that include CDR sequences which specifically recognize a polypeptide of the invention. The invention also provides anti-idiotype antibodies immunospecific for antibodies of the invention.

According to another aspect of the invention, methods are provided for identifying novel anti-bacterial agents that modulate the function of gram negative bacteria virulence genes or gene products. Methods of the invention include screening potential agents for the ability to interfere with expression of virulence gene products encoded by the DNA sequences set forth in any one of SEQ ID NOS: 1, 3, 7, 9, 11, 13, 15, 17, 19, 21, 23, 25, 29, 31, 33, 37, 39, 41, 51, 53, 55, 57, 58, 60, 68, 70, 72, 74, 76, 78, 80, 82, 84, 100, 102, 104, 106, 108, 110, 112, 114, 116, 118, 120, 122, 124, 126, 128, 130, 132, 134, 135, 136, 138, 140, 142, 144, 146, 148, 150, 152, 154, 156, 158, 160, 162, 163, and 164, or species homologs thereof, or screening potential agents for the ability to interfere with biological function of a bacterial gene product encoded in whole or in part by a DNA sequence set forth in any one of SEQ ID NOS: 1, 3, 7, 9, 11, 13, 15, 17, 19, 21, 23, 25, 29, 31, 33, 37, 39, 41, 51, 53, 55, 57, 58, 60, 68, 70, 72, 74, 76, 78, 80, 82, 84, 100, 102, 104, 106, 108, 110, 112, 114, 116, 118, 120, 122, 124, 126, 128, 130, 132, 134, 135, 136, 138, 140, 142, 144, 146, 148, 150, 152, 154, 156, 158, 160, 162, 163, and 164, species homologs thereof, or the complementary strand thereof, followed by identifying agents that provide positive results in such screening assays. In particular, agents that interfere with the expression of virulence gene products include anti-sense polynucleotides and ribozymes that are complementary to the virulence gene sequences. The invention further embraces methods to modulate transcription of gene products of the invention through use of oligonucleotide-directed triplet helix formation.

Agents that interfere with the function of virulence gene products include variants of virulence gene products, binding partners of the virulence gene products and variants of such binding partners, and enzyme inhibitors (where the product is an enzyme).

Novel anti-bacterial agents identified by the methods described herein are provided, as well as methods for treating a subject suffering from infection with gram negative bacteria involving administration of such novel anti-bacterial agents in an amount effective to reduce bacterial presence.

Numerous additional aspects and advantages of the invention will become apparent to those skilled in the art upon consideration of the following detailed description of the invention which describes presently prepared embodiments thereof.

DETAILED DESCRIPTION OF THE INVENTION

"Virulence genes," as used herein, are genes whose function or products are required for successful establishment and/or maintenance of bacterial infection in a host animal. Thus, virulence genes and/or the proteins encoded thereby are involved in pathogenesis in the host organism, but may not be necessary for growth.

"Signature-tagged mutagenesis (STM)," as used herein, is a method generally described in International Patent Publication No. WO 96/17951, incorporated herein by reference, and includes, for example, a method for identifying bacterial genes required for virulence in a murine model of bacteremia. In this method, bacterial strains that each have a random mutation in the genome are produced using transposon integration; each insertional mutation carries a different DNA signature tag which allows mutants to be differentiated from each other. The tags comprise 40 bp variable central regions flanked by invariant "arms" of 20 bp which allow the central portions to be co-amplified by polymerase chain reaction (PCR). Tagged mutant strains are assembled in microtiter dishes, then combined to form the "inoculum pool" for infection studies. At an appropriate time after inoculation, bacteria are isolated from the animal and pooled to form the "recovered pool." The tags in the recovered pool and the tags in the inoculum pool are separately amplified, labeled, and then used to probe filters arrayed with all of the different tags representing the mutants in the inoculum. Mutant strains with attenuated virulence are those which cannot be recovered from the infected animal, i.e., strains with tags that give hybridization signals when probed with tags from the inoculum pool but not when probed with tags from the recovered pool. In a variation of this method, non-radioactive detection methods such as chemiluminescence can be used Signature-tagged mutagenesis allows a large number of insertional mutant strains to be screened simultaneously in a single animal for loss of virulence. Screening nineteen pools of mutant *P. multocida* strains resulted in the identification of more than 60 strains with reduced virulence, many of which were confirmed to be attenuated in virulence by subsequent determination of an approximate LD 50, for the individual mutants. Screening of *A. pleuropneumoniae* mutants resulted in identification of more than 100 strains having mutations in 35 different genes. Of these, mutations in 22 genes results in significantly attenuated *A. pleuropneumoniae* strains. The nucleotide sequence of the open reading frame disrupted by the transposon insertion was determined by sequencing both strands and an encoded amino acid sequence was deduced. Novelty of both the polynucleotide and amino acid sequences was determined by comparison of the sequences with DNA and protein database sequences.

The identification of bacterial, and more particularly *P. multocida* and *A. pleuropneumoniae* virulence genes provides for microorganisms exhibiting reduced virulence (i.e., attenuated strains), which are useful in vaccines. Such microorganisms include Pasteurellaceae mutants containing at least one functional mutation inactivating a gene represented by any one of SEQ ID NOS: 1, 3, 7, 9, 11, 13, 15, 17, 19, 21, 23, 25, 29, 31, 33, 37, 39, 41, 51, 53, 55, 57, 58, 60, 68, 70, 72, 74, 76, 78, 80, 82, 84, 100, 102, 104, 106, 108, 110, 112, 114, 116, 118, 120, 122, 124, 126, 128, 130, 132, 134, 135, 136, 138, 140, 142, 144, 146, 148, 150, 152, 154, 156, 158, 160, 162, 163, and 164. The worker of ordinary skill in the art will realize that a "functional mutation" may occur in protein coding regions of a gene of the invention, as well as in regulatory regions that modulate transcription of the virulence gene RNA.

The worker of ordinary skill will also appreciate that attenuated *P. multocida* and *A. pleuropneumoniae* strains of the invention include those bearing more than one functional mutation. More than one mutation may result in additive or synergistic degrees of attenuation. Multiple mutations can be prepared by design or may fortuitously arise from a deletion event originally intended to introduce a single mutation. An example of an attenuated strain with multiple deletions is a *Salmonella typhimurium* strain wherein the cya and crp genes are functionally deleted. This mutant *S. typhimurium* strain has shown promise as a live vaccine.

Identification of virulence genes in *P. multocida* and *A. pleuropneumoniae* can provide information regarding similar genes, i.e., species homologs, in other pathogenic species. As an example, identification of the aroA gene led to identification of conserved genes in a diverse number of pathogens, including *P. haemolytica, Aeromonas hydrophila, Aeromonas salmonicida, Salmonella typhimurium, Salmonella enteritidis, Salmonella dublin, Salmonella gallanerum, Bordella pertussis, Yersinia entericolitica, Neisseria gonorrhoeae,* and *Bacillus anthracis*. In many of these species, attenuated bacterial strains bearing mutations in the aroA gene have proven to be effective in vaccine formulations. Using the virulence genes sequences identified in *P. multocida*, similar or homologous genes can be identified in other organisms, particularly within the Pasteurella family, as well as *A. pleuropneumoniae* and *Haemophilus somnus*. Likewise, identification of *A. pleuropneumoniae* virulence genes can permit identification of related genes in other organisms. Southern hybridization using the *P. multocida* and *A. pleuropneumoniae* genes as probes can identify these related genes in chromosomal libraries derived from other organisms. Alternatively, PCR can be equally effective in gene identification across species boundaries. As still another alternative, complementation of, for example, a *P. multocida* mutant with a chromosomal library from other species can also be used to identify genes having the same or related virulence activity. Identification of related virulence genes can therefore lead to production of an attenuated strain of the other organism which can be useful as still another vaccine formulation. Examples of *P. multocida* genes that have been demonstrated to exist in other species (e.g. *P. haemolytica, A. pleuropneumoniae* and *H. somnus*) include genes exbB, atpG, and pnp Attenuated *P. multocida* strains identified using STM are insertional mutants wherein a virulence gene has been rendered non-functional through insertion of transposon sequences in either the open reading frame or regulatory DNA sequences. In one aspect, therefore, the attenuated *P. multocida* strains, as well as other gram-negative mutant bacterial strains of the invention can bear one or more mutations which result in an insertion in the gene, with the insertion causing decreased expression of a gene product encoded by the mutated gene and/or expression of an inactive gene product encoded by the mutated gene. These insertional mutants still contain all of the genetic information required for bacterial virulence and can possibly revert to apathogenic state by deletion of the inserted transposon. Therefore, in preparing a vaccine formulation, it is desirable to take the information gleaned from the attenuated strain and create a deletion mutant strain wherein some, most, or all of the virulence gene sequence is removed, thereby precluding the possibility that the bacteria will revert to a virulent state. The attenuated *P. multocida* strains, as well as other gram-negative mutant bacterial strains of the invention therefore include those bearing one or more mutation which results in deletion of at least about 10%, at least about 20%, at least about 30%, at least about 40% at least about 50%, at least about 60%, at least about 70%, at least about 80%, at least about 90%, at least about 95%, at least about 98%, or at least about 99% of the virulence gene.

The vaccine properties of an attenuated insertional mutant identified using STM are expected to be the same or similar to those of a bacteria bearing a deletion in the same gene. However, it is possible that an insertion mutation may exert "polar" effects on adjoining gene sequences, and as a result, the insertion mutant may possess characteristic distinct from a mutant strain with a deletion in the same gene sequence. Deletion mutants can be constructed using any of a number of techniques well known and routinely practiced in the art.

In one example, a strategy using counterselectable markers can be employed which has commonly been utilized to delete genes in many bacteria. For a review, see, for example, Reyrat, et al., *Infection and Immunity* 66:4011-4017 (1998), incorporated herein by reference. In this technique, a double selection strategy is often employed wherein a plasmid is constructed encoding both a selectable and counterselectable marker, with flanking DNA sequences derived from both sides of the desired deletion. The selectable marker is used to select for bacteria in which the plasmid has integrated into the genome in the appropriate location and manner. The counterselectable marker is used to select for the very small percentage of bacteria that have spontaneously eliminated the integrated plasmid. A fraction of these bacteria will then contain only the desired deletion with no other foreign DNA present. The key to the use of this technique is the availability of a suitable counterselectable marker.

In another technique, the cre-lox system is used for site specific recombination of DNA. The system consists of 34 base pair lox sequences that are recognized by the bacterial cre recombinase gene. If the lox sites are present in the DNA in an appropriate orientation, DNA flanked by the lox sites will be excised by the cre recombinase, resulting in the deletion of all sequences except for one remaining copy of the lox sequence. Using standard recombination techniques, it is possible to delete the targeted gene of interest in the *P. multocida* or *A. pleuropneumoniae* genome and to replace it with a selectable marker (e.g., a gene coding for kanamycin resistance) that is flanked by the lox sites. Transient expression (by electroporation of a suicide plasmid containing the cre gene under control of a promoter that functions in *P. multocida* or *A. pleuropneumoniae*) of the cre recombinase should result in efficient elimination of the lox flanked marker. This process would result in a mutant containing the desired deletion mutation and one copy of the lox sequences.

In another approach, it is possible to directly replace a desired deleted sequence in the *P. multocida* or *A. pleuropneumoniae* genome with a marker gene, such as green fluorescent protein (GFP), β-galactosidase, or luciferase. In this technique, DNA segments flanking a desired deletion are prepared by PCR and cloned into a suicide (non-replicating) vector for *P. multocida* or *A. pleuropneumoniae*. An expression cassette, containing a promoter active in *P. multocida* or *A. pleuropneumoniae* and the appropriate marker gene, is cloned between the flanking sequences. The plasmid is introduced into wild-type *P. multocida* or *A. pleuropneumoniae*. Bacteria that incorporate and express the marker gene (probably at a very low frequency) are isolated and examined for the appropriate recombination event (i.e., replacement of the wild type gene with the marker gene).

The reduced virulence of these organisms and their immunogenicity may be confirmed by administration to a subject animal. While it is possible for an avirulent microorganism of the invention to be administered alone, one or more of such mutant microorganisms are preferably administered in a vaccine composition containing suitable adjuvant(s) and pharmaceutically acceptable diluent(s) or carrier(s). The carrier(s) must be "acceptable" in the sense of being compatible with the avirulent microorganism of the invention and not deleterious to the subject to be immunized. Typically, the carriers will be water or saline which will be sterile and pyrogen free. The subject to be immunized is a subject needing protection from a disease caused by a virulent form of *P. multocida*, *A. pleuropneumoniae*, or other pathogenic microorganisms.

It will be appreciated that the vaccine of the invention may be useful in the fields of human medicine and veterinary medicine. Thus, the subject to be immunized may be a human or other animal, for example, farm animals including cows, sheep, pigs, horses, goats and poultry (e.g., chickens, turkeys, ducks and geese) companion animals such as dogs and cats; exotic and/or zoo animals; and laboratory animals including mice, rats, rabbits, guinea pigs, and hamsters.

The invention also provides polypeptides and corresponding polynucleotides required for *P. multocida* or *A. pleuropneumoniae* virulence. The invention includes both naturally occurring and non-naturally occurring polynucleotides and polypeptide products thereof. Naturally occurring virulence products include distinct gene and polypeptide species as well as corresponding species homologs expressed in organisms other than *P. multocida* or *A. pleuropneumoniae* strains. Non-naturally occurring virulence products include variants of the naturally occurring products such as analogs and virulence products which include covalent modifications. In a preferred embodiment, the invention provides virulence polynucleotides comprising the sequences set forth in SEQ ID NOs: 1, 3, 7, 9, 11, 13, 15, 17, 19, 21, 23, 25, 29, 31, 33, 37, 39, 41, 51, 53, 55, 57, 58, 60, 68, 70, 72, 74, 76, 78, 80, 82, 84, 100, 102, 104, 106, 108, 110, 112, 114, 116, 118, 120, 122, 124, 126, 128, 130, 132, 134, 135, 136, 138, 140, 142, 144, 146, 148, 150, 152, 154, 156, 158, 160, 162, 163, and 164, and species homologs thereof, and polypeptides having amino acids sequences encoded by the polynucleotides.

The present invention provides novel purified and isolated *P. multocida* and *A. pleuropneumoniae* polynucleotides (e.g., DNA sequences and RNA transcripts, both sense and complementary antisense strands) encoding the bacterial virulence gene products. DNA sequences of the invention include genomic and cDNA sequences as well as wholly or partially chemically synthesized DNA sequences. Genomic DNA of the invention comprises the protein coding region for a polypeptide of the invention and includes variants that may be found in other bacterial strains of the same species. "Synthesized," as used herein and is understood in the art, refers to purely chemical, as opposed to enzymatic, methods for producing polynucleotides. "Wholly" synthesized DNA sequences are therefore produced entirely by chemical means, and "partially" synthesized DNAs embrace those wherein only portions of the resulting DNA were produced by chemical means. Preferred DNA sequences encoding *P. multocida* virulence gene products are set out in SEQ ID NOs: 1, 3, 7, 9, 11, 13, 15, 17, 19, 21, 23, 25, 29, 31, 33, 37, 39, 41, 51, 53, 55, 57, 58, 60, 68, 70, 72, 74, 76, 78, 80, 82, 84, 100, 102, 104, 106, 108, 110, 112, 114, 116, 118, and 120, 122, 124, 126, 128, 130, 132, 134, 135, 136, 138, 140, 142, 144, 146, 148, 150, 152, 154, 156, 158, 160, 162, 163, and 164, and species homologs thereof. Preferred *A. pleuropneumoniae* DNA sequences encoding virulence gene products are set out in SEQ ID NOs: 122, 124, 126, 128, 130, 132, 134, 135, 136, 138, 140, 142, 144, 146, 148, 150, 152, 154, 156, 158, 160, 162, 163, and 164, and species homologs thereof. The worker of skill in the art will readily appreciate that the preferred DNA of the invention comprises a double stranded molecule, for example, molecules having the sequences set forth in SEQ ID NOs: 1, 3, 7, 9, 11, 13, 15, 17, 19, 21, 23, 25, 29, 31, 33, 37, 39, 41, 51, 53, 55, 57, 58, 60, 68, 70, 72, 74, 76, 78, 80, 82, 84, 100, 102, 104, 106, 108, 110, 112, 114, 116, 118, and 120, 122, 124, 126, 128, 130, 132, 134, 135, 136, 138, 140, 142, 144, 146, 148, 150, 152, 154, 156, 158, 160, 162, 163, and 164, and species homologs thereof, along with the complementary molecule (the "non-coding strand" or "complement") having a sequence deducible from the sequence of SEQ ID NO: 1, 3, 7, 9, 11, 13, 15, 17, 19, 21, 23, 25, 29, 31, 33, 37, 39, 41, 51, 53, 55, 57, 58, 60, 68, 70, 72, 74, 76, 78, 80, 82, 84, 100, 102, 104, 106, 108, 110, 112, 114, 116, 118, and 120, 122, 124, 126, 128, 130, 132, 134, 135, 136, 138, 140, 142, 144, 146, 148, 150, 152, 154, 156, 158, 160, 162, 163, and 164, according to Watson-Crick base pairing rules for DNA. Also preferred are polynucleotides encoding the gene products encoded by any one of the polynucleotides set out in SEQ ID NOs: 1, 3, 7, 9, 11, 13, 15, 17, 19, 21, 23, 25, 29, 31, 33, 37, 39, 41, 51, 53, 55, 57, 58, 60, 68, 70, 72, 74, 76, 78, 80, 82, 84, 100, 102, 104, 106, 108, 110, 112, 114, 116, 118, and 120, 122, 124, 126, 128, 130, 132, 134, 135, 136, 138, 140, 142, 144, 146, 148, 150, 152, 154, 156, 158, 160, 162, 163, and 164, and species homologs thereof. The invention further embraces species, preferably bacterial, homologs of the *P. multocida* and *A. pleuropneumoniae* DNA.

The polynucleotide sequence information provided by the invention makes possible the identification and isolation of polynucleotides encoding related bacterial virulence molecules by well known techniques including Southern and/or Northern hybridization, and polymerase chain reaction (PCR). Examples of related polynucleotides include polynucleotides encoding polypeptides homologous to a virulence gene product encoded by any one of the polynucleotides set out in SEQ ID NOs: 1, 3, 7, 9, 11, 13, 15, 17, 19, 21, 23, 25, 29, 31, 33, 37, 39, 41, 51, 53, 55, 57, 58, 60, 68, 70, 72, 74, 76, 78, 80, 82, 84, 100, 102, 104, 106, 108, 110, 112, 114, 116, 118, and 120, 122, 124, 126, 128, 130, 132, 134, 135, 136, 138, 140, 142, 144, 146, 148, 150, 152, 154, 156, 158, 160, 162, 163, and 164, and species homologs thereof, and structurally related polypeptides sharing one or more biological and/or physical properties of a virulence gene product of the invention.

The invention also embraces DNA sequences encoding bacterial gene products which hybridize under moderately to highly stringent conditions to the non-coding strand, or complement, of any one of the polynucleotides set out in SEQ ID NOs: 1, 3, 7, 9, 11, 13, 15, 17, 19, 21, 23, 25, 29, 31, 33, 37, 39, 41, 51, 53, 55, 57, 58, 60, 68, 70, 72, 74, 76, 78, 80, 82, 84, 100, 102, 104, 106, 108, 110, 112, 114, 116, 118, and 120, 122, 124, 126, 128, 130, 132, 134, 135, 136, 138, 140, 142, 144, 146, 148, 150, 152, 154, 156, 158, 160, 162, 163, and 164, and species homologs thereof DNA sequences encoding virulence polypeptides which would hybridize thereto but for the degeneracy of the genetic code are contemplated by the invention. Exemplary high stringency conditions include a final wash in buffer comprising 0.2×SSC/0.1% SDS, at 65° C. to 75° C., while exemplary moderate stringency conditions include a final wash in buffer comprising 2×SSC/0.1% SDS, at 35° C. to 45° C. It is understood in the art that conditions of equivalent stringency can be achieved through variation of temperature and buffer, or salt concentration as described in Ausubel, et al. (Eds.), *Protocols in Molecular Biology*, John Wiley and & Sons (1994), pp. 6.0.3 to 6.4.10. Modifications in hybridization conditions can be empirically determined or precisely calculated based on the length and the percentage of guanosine/cytosine (GC) base pairing of the probe. The hybridization conditions can be calculated as described in Sambrook, et al., (Eds.), *Molecular Cloning: A Laboratory Manual*, Cold Spring Harbor Laboratory Press: Cold Spring Harbor, N.Y. (1989), pp. 9;47 to 9.51.

Autonomously replicating recombinant expression constructions such as plasmid and viral DNA vectors incorporating virulence gene sequences are also provided. Expression constructs wherein virulence polypeptide-encoding polynucleotides are operatively linked to an endogenous or exogenous expression control DNA sequence and a transcription terminator are also provided. The virulence genes may be cloned by PCR, using *P. multocida* genomic DNA as the template. For ease of inserting the gene into expression vectors, PCR primers are chosen so that the PCR-amplified gene has a restriction enzyme site at the 5' end preceding the initiation codon ATG, and a restriction enzyme site at the 3' end after the termination codon TAG, TGA or TAA. If desirable, the codons in the gene are changed, without changing the amino acids, according to *E. coli* codon preference described by Grosjean and Fiers, *Gene,* 18:199-209 (1982), and Konigsberg and Godson, *Proc. Natl. Acad. Sci.* (USA), 80:687-691 (1983). Optimization of codon usage may lead to an increase in the expression of the gene product when produced in *E. coli*. If the gene product is to be produced extracellularly, either in the periplasm of *E. coli* or other bacteria, or into the cell culture medium, the gene is cloned without its initiation codon and placed into an expression vector behind a signal sequence.

According to another aspect of the invention, host cells are provided, including procaryotic and eukaryotic cells, either stably or transiently transformed, transfected, or electroporated with polynucleotide sequences of the invention in a manner which permits expression of virulence polypeptides of the invention. Expression systems of the invention include bacterial, yeast, fungal, viral, invertebrate, and mammalian cells systems. Host cells of the invention are a valuable source of immunogen for development of antibodies specifically immunoreactive with the virulence gene product. Host cells of the invention are conspicuously useful in methods for large scale production of virulence polypeptides wherein the cells are grown in a suitable culture medium and the desired polypeptide products are isolated from the cells or from the medium in which the cells are grown by, for example, immunoaffinity purification or any of the multitude of purification techniques well known and routinely practiced in the art. Any suitable host cell may be used for expression of the gene product, such as *E. coli*, other bacteria, including *P. multocida, Bacillus* and *S. aureus*, yeast, including *Pichia pastoris* and *Saccharomyces cerevisiae*, insect cells, or mammalian cells, including CHO cells, utilizing suitable vectors known in the art. Proteins may be produced directly or fused to a peptide or polypeptide, and either intracellularly or extracellularly by secretion into the periplasmic space of a bacterial cell or into the cell culture medium. Secretion of a protein requires a signal peptide (also known as pre-sequence); a number of signal sequences from prokaryotes and eukaryotes are known to function for the secretion of recombinant proteins. During the protein secretion process, the signal peptide is removed by signal peptidase to yield the mature protein.

To simplify the protein purification process, a purification tag may be added either at the 5' or 3' end of the gene coding sequence. Commonly used purification tags include a stretch of six histidine residues (U.S. Pat. Nos. 5,284,933 and 5,310, 663), a streptavidin-affinity tag described by Schmidt and Skerra, *Protein Engineering,* 6:109-122 (1993), a FLAG peptide [Hopp et al., *Biotechnology,* 6:1205-1210 (1988)], glutathione S-transferase [Smith and Johnson, *Gene,* 67:31-40 (1988)], and thioredoxin [LaVallie et al., *Bio/Technology,* 11:187-193 (1993)]. To remove these peptide or polypeptides, a proteolytic cleavage recognition site may be inserted at the fusion junction. Commonly used proteases are factor Xa, thrombin, and enterokinase.

The invention also provides purified and isolated *P. multocida* and *A. pleuropneumoniae* virulence polypeptides encoded by a polynucleotide of the invention. Presently preferred are polypeptides comprising the amino acid sequences encoded by any one of the polynucleotides set out in SEQ ID NOs: 1, 3, 7, 9, 11, 13, 15, 17, 19, 21, 23, 25, 29, 31, 33, 37, 39, 41 51, 53, 55, 57, 58, 60, 68, 70, 72, 74, 76, 78, 80, 82, 84, 100, 102, 104, 106, 108, 110, 112, 114, 116, 118, and 120, 122, 124, 126, 128, 130, 132, 134, 135, 136, 138, 140, 142, 144, 146, 148, 150, 152, 154, 156, 158, 160, and 164, and species homologs thereof. The invention embraces virulence polypeptides encoded by a DNA selected from the group consisting of: a) the DNA sequence set out in any one of SEQ ID NOs: 1, 3, 7, 9, 11, 13, 15, 17, 19, 21, 23, 25, 29, 31, 33, 37, 39, 41, 51, 53, 55, 57, 58, 60, 68, 70, 72, 74, 76, 78, 80, 82, 84, 100, 102, 104, 106 108, 110, 112, 114, 116, 118, and 120, 122, 124, 126, 128, 130, 132, 134, 135, 136, 138, 140, 142, 144, 146, 148, 150, 152, 154, 156, 158, 160, and 164, and species homologs thereof; b) DNA molecules encoding *P. multocida* or *A. pleuropneumoniae* polypeptides encoded by any one of SEQ ID NOs: 1, 3, 7, 9, 11, 13, 15, 17, 19, 21, 23, 25, 29, 31, 33, 37, 39, 41, 51, 53, 55, 57, 58, 60, 68, 70, 72, 74, 76, 78, 80, 82, 84, 100, 102, 104, 106, 108, 110, 112, 114, 116, 118, and 120, 122, 124, 126, 128, 130, 132, 134, 135, 136, 138, 140, 142, 144, 146, 148, 150, 152, 154, 156, 158, 160, and 164, and species homologs thereof, and c) a DNA molecule, encoding a virulence gene product, that hybridizes under moderately stringent conditions to the DNA of (a) or (b).

The invention also embraces polypeptides, i.e., species homologs and orthologs, that have at least about 99%, at least about 95%, at least about 90%, at least about 85%, at least about 80%, at least about 75%, at least about 70%, at least about 65%, at least about 60%, at least about 55%, and at least about 50% identity and/or homology to the preferred polypeptides of the invention. Percent amino acid sequence "identity" with respect to the preferred polypeptides of the invention is defined herein as the percentage of amino acid residues in the candidate sequence that are identical with the residues in the virulence gene product sequence after aligning both sequences and introducing gaps, if necessary, to achieve the maximum percent sequence identity, and not considering any conservative substitutions as part of the sequence identity. Percent sequence "homology" with respect to the preferred polypeptides of the invention is defined herein as the percentage of amino acid residues in the candidate sequence that are identical with the residues in one of the virulence polypeptide sequences after aligning the sequences and introducing gaps, if necessary, to achieve the maximum percent sequence identity, and also considering any conservative substitutions as part of the sequence identity. Conservative substitutions can be defined as set out in Tables A and B.

TABLE A

Conservative Substitutions I

| SIDE CHAIN CHARACTERISTIC | | AMINO ACID |
|---|---|---|
| Aliphatic | Non-polar | G, A, P |
| | | I, L, V |
| | Polar- uncharged | C, S, T, M |
| | | N, Q |
| | Polar - charged | D, E |
| | | K, R |
| Aromatic | | H, F, W, Y |
| Other | | N, Q, D, E |

Polypeptides of the invention may be isolated from natural bacterial cell sources or may be chemically synthesized, but are preferably produced by recombinant procedures involving host cells of the invention. Virulence gene products of the invention may be full length polypeptides, biologically active fragments, or variants thereof which retain specific biological or immunological activity. Variants may comprise virulence polypeptide analogs wherein one or more of the specified (i.e., naturally encoded) amino acids is deleted or replaced or wherein one or more non-specified amino acids are added: (1) without loss of one or more of the biological activities or immunological characteristics specific for the virulence gene product; or (2) with specific disablement of a particular biological activity of the virulence gene product. Deletion variants contemplated also include fragments lacking portions of the polypeptide not essential for biological activity, and insertion variants include fusion polypeptides in which the wild-type polypeptide or fragment thereof have been fused to another polypeptide.

Variant virulence polypeptides include those wherein conservative substitutions have been introduced by modification of polynucleotides encoding polypeptides of the invention. Conservative substitutions are recognized in the art to classify amino acids according to their related physical properties and can be defined as set out in Table A (from WO 97/09433, page 10, published Mar. 13, 1997 (PCT/GB96/02197, filed Sep. 6, 1996). Alternatively, conservative amino acids can be grouped as defined in Lehninger, [*Biochemistry*, Second Edition; Worth Publishers, Inc. NY:NY (1975), pp. 71-77] as set out in Table B.

TABLE B

Conservative Substitutions II

| SIDE CHAIN CHARACTERISTIC | AMINO ACID |
|---|---|
| Non-polar (hydrophobic) | |
| A. Aliphatic: | A, L, I, V, P |
| B. Aromatic: | F, W |
| C. Sulfur-containing: | M |
| D. Borderline: | G |
| Uncharged-polar | |
| A. Hydroxyl: | S, T, Y |
| B. Amides: | N, Q |
| C. Sulfhydryl: | C |
| D. Borderline: | G |
| Positively Charged (Basic): | K, R, H |
| Negatively Charged (Acidic): | D, E |

Variant virulence products of the invention include mature virulence gene products, i.e., wherein leader or signal sequences are removed, having additional amino terminal residues. Virulence gene products having an additional methionine residue at position-1 are contemplated, as are virulence products having additional methionine and lysine residues at positions-2 and -1. Variants of these types are particularly useful for recombinant protein production in bacterial cell types. Variants of the invention also include gene products wherein amino terminal sequences derived from other proteins have been introduced, as well as variants comprising amino terminal sequences that are not found in naturally occurring proteins.

The invention also embraces variant polypeptides having additional amino acid residues which result from use of specific expression systems. For example, use of commercially available vectors that express a desired polypeptide as a fusion protein with glutathione-S-transferase (GST) provide the desired polypeptide having an additional glycine residue at position-1 following cleavage of the GST component from the desired polypeptide. Variants which result from expression using other vector systems are also contemplated.

Also comprehended by the present invention are antibodies (e.g., monoclonal and polyclonal antibodies, single chain antibodies, chimeric antibodies, humanized, human, and CDR-grafted antibodies, including compounds which include CDR sequences which specifically recognize a polypeptide of the invention) and other binding proteins specific for virulence gene products or fragments thereof. The term "specific for" indicates that the variable regions of the antibodies of the invention recognize and bind a virulence polypeptide exclusively (i.e., are able to distinguish a single virulence polypeptides from related virulence polypeptides despite sequence identity, homology, or similarity found in the family of polypeptides), but may also interact with other proteins (for example, *S. aureus* protein A or other antibodies in ELISA techniques) through interactions with sequences outside the variable region of the antibodies, and in particular, in the constant region of the molecule. Screening assays to determine binding specificity of an antibody of the invention are well known and routinely practiced in the art. For a comprehensive discussion of such assays, see Harlow et al. (Eds), *Antibodies A Laboratory Manual*; Cold Spring Harbor Laboratory; Cold Spring Harbor, N.Y. (1988), Chapter 6. Antibodies that recognize and bind fragments of the virulence polypeptides of the invention are also contemplated, provided that the antibodies are first and foremost specific for, as defined above, a virulence polypeptide of the invention from which the fragment was derived.

The DNA and amino acid sequence information provided by the present invention also makes possible the systematic analysis of the structure and function of the virulence genes and their encoded gene products. Knowledge of a polynucleotide encoding a virulence gene product of the invention also makes available anti-sense polynucleotides which recognize and hybridize to polynucleotides encoding a virulence polypeptide of the invention. Full length and fragment anti-sense polynucleotides are provided. The worker of ordinary skill will appreciate that fragment anti-sense molecules of the invention include (i) those which specifically recognize and hybridize to a specific RNA (as determined by sequence comparison of DNA encoding a virulence polypeptide of the invention to DNA encoding other known molecules) as well as (ii) those which recognize and hybridize to RNA encoding variants of the family of virulence proteins. Antisense polynucleotides that hybridize to RNA encoding other members of the virulence family of proteins are also identifiable through sequence comparison to identify characteristic, or signature, sequences for the family of molecules.

The invention further contemplates methods to modulate gene expression through use of ribozymes. For a review, see Gibson and Shillitoe, *Mol. Biotech.* 7:125-137 (1997). Ribozyme technology can be utilized to inhibit translation of mRNA in a sequence specific manner through (i) the hybridization of a complementary RNA to a target mRNA and (ii) cleavage of the hybridized mRNA through nuclease activity inherent to the complementary strand. Ribozymes can be identified by empirical methods but more preferably are specifically designed based on accessible sites on the target mRNA [Bramlage, et al., *Trends in Biotech* 16:434-438 (1998)]. Delivery of ribozymes to target cells can be accomplished using either exogenous or endogenous delivery techniques well known and routinely practiced in the art. Exogenous delivery methods can include use of targeting liposomes or direct local injection. Endogenous methods include use of viral vectors and non-viral plasmids.

Ribozymes can specifically modulate expression of virulence genes when designed to be complementary to regions unique to a polynucleotide encoding a virulence gene product. "Specifically modulate" therefore is intended to mean that ribozymes of the invention recognizes only a single polynucleotide. Similarly, ribozymes can be designed to modulate expression of all or some of a family of proteins. Ribozymes of this type are designed to recognize polynucleotide sequences conserved in all or some of the polynucleotides which encode the family of proteins.

The invention further embraces methods to modulate transcription of a virulence gene of the invention through use of oligonucleotide-directed triplet helix formation. For a review, see Lavrovsky, et al., *Biochem. Mol. Med.* 62:11-22 (1997). Triplet helix formation is accomplished using sequence specific oligonucleotides which hybridize to double stranded DNA in the major groove as defined in the Watson-Crick model. Hybridization of a sequence specific oligonucleotide can thereafter modulate activity of DNA-binding proteins, including, for example, transcription factors and polymerases. Preferred target sequences for hybridization include transcriptional regulatory regions that modulate virulence gene product expression. Oligonucleotides which are capable of triplet helix formation are also useful for site-specific covalent modification of target DNA sequences. Oligonucleotides useful for covalent modification are coupled to various DNA damaging agents as described in Lavrovsky, et al. [supra].

The identification of *P. multocida* and *A. pleuropneumoniae* virulence genes renders the genes and gene products useful in methods for identifying anti-bacterial agents. Such methods include assaying potential agents for the ability to interfere with expression of virulence gene products represented by the DNA sequences set forth in any one of SEQ ID NOS: 1, 3, 7, 9, 11, 13, 15, 17, 19, 21, 23, 25, 29, 31, 33, 37, 39, 41, 51, 53, 55, 57, 58, 60, 68, 70, 72, 74, 76, 78, 80, 82 84, 100, 102, 104, 106, 108, 110, 112, 114, 116, 118, and 120, 122, 124, 126, 128, 130, 132, 134, 135, 136, 138, 140, 142, 144, 146, 148, 150, 152, 154, 156, 158, 160, 162, 163, and 164, and species homologs thereof (i.e., the genes represented by DNA sequences of SEQ ID NOS: 1, 3, 7, 9, 11, 13, 15, 17, 19, 21, 23, 25, 29, 31, 33, 37, 39, 41, 51, 53, 55, 57, 58, 60, 68, 70, 72, 74, 76, 78, 80, 82, 84 100, 102, 104, 106, 108, 110, 112, 114, 116, 118, and 120, 122, 124, 126, 128, 130, 132, 134, 135, 136, 138, 140, 142, 144, 146, 148, 150, 152, 154, 156, 158, 160, 162, 163, and 164, encode the virulence gene product, or the DNA sequences of SEQ ID NOS: 1, 3, 7, 9, 11, 13, 15, 17, 19, 21, 23, 25, 29, 31, 33, 37, 39, 41, 51, 53, 55, 57, 58, 60, 68, 70, 72, 74, 76, 78, 80, 82, 84, 100, 102, 104, 106, 108, 110, 112, 114, 116, 118, and 120, 122, 124, 126, 128, 130, 132, 134, 135, 136, 138, 140, 142, 144, 146, 148, 150, 152, 154, 156, 158, 160, 162, 163, and 164, are adjacent to gene encoding the virulence gene product, or are involved in regulation of expression of the virulence gene product), or assaying potential agents for the ability to interfere with the function of a bacterial gene product encoded in whole or in part by a DNA sequence set forth in any one of SEQ ID NOs: 1, 3, 7, 9, 11, 13, 15, 17, 19, 21, 23, 25, 29, 31, 33, 37, 39, 41, 51, 53, 55, 57, 58, 60, 68, 70, 72, 74, 76, 78, 80, 82, 84, 100, 102, 104, 106, 108, 110, 112, 114, 116, 118, and 120, 122, 124, 126, 128, 130, 132, 134, 135, 136, 138, 140, 142, 144, 146, 148, 150, 152, 154, 156, 158, 160, 162, 163, and 164, species homologs thereof, or the complementary strand thereof, followed by identifying agents that are positive in such assays. Polynucleotides and polypeptides useful, in these assays include not only the genes and encoded polypeptides as disclosed herein, but also variants thereof that have substantially the same activity as the wild-type genes and polypeptides.

The virulence gene products produced by the methods described above are used in high throughput assays to screen for inhibitory agents. The sources for potential agents to be screened are chemical compound libraries, fermentation media of Streptomycetes, other bacteria and fungi, and cell extracts of plants and other vegetations. For proteins with known enzymatic activity, assays are established based on the activity, and a large number of potential agents are screened for ability to inhibit the activity. For proteins that interact with another protein or nucleic acid, binding assays are established to measure such interaction directly, and the potential agents are screened for ability to inhibit the binding interaction.

The use of different assays known in the art is contemplated according to this aspect of the invention. When the function of the virulence gene product is known or predicted by sequence similarity to a known gene product, potential inhibitors can be screened in enzymatic or other types of biological and/or biochemical assays keyed to the function and/or properties of the gene product. When the virulence gene product is known or predicted by sequence similarity to a known gene product to interact with another protein or nucleic acid, inhibitors of the interaction can be screened directly in binding assays. The invention contemplates a multitude of assays to screen and identify inhibitors of binding by the virulence gene product. In one example, the virulence gene product is immobilized and interaction with a binding partner is assessed in the presence and absence of a putative inhibitor compound. In another example, interaction between the virulence gene product and its binding partner is assessed in a solution assay, both in the presence and absence of a putative inhibitor compound. In both assays, an inhibitor is identified as a compound that decreases binding between the virulence gene product and its binding partner. Other assays are also contemplated in those instances wherein the virulence gene product binding partner is a protein. For example, variations of the di-hybrid assay are contemplated wherein an inhibitor of protein/protein interactions is identified by detection of a positive signal in a transformed or transfected host cell as described in PCT publication number WO 95/20652, published Aug. 3, 1995.

Candidate inhibitors contemplated by the invention include compounds selected from libraries of potential inhibitors. There are a number of different libraries used for the identification of small molecule modulators, including: (1) chemical libraries, (2) natural product libraries, and (3) combinatorial libraries comprised of random peptides, oligonucleotides or organic molecules. Chemical libraries consist of structural analogs of known compounds or compounds that are identified as "hits" or "leads" via natural product screening. Natural product libraries are collections of microorganisms, animals, plants, or marine organisms which are used to create mixtures for screening by: (1) fermentation and extraction of broths from soil, plant or marine microorganisms or (2) extraction of plants or marine organisms. Natural product libraries include polyketides, non-ribosomal peptides, and variants (non-naturally occurring) thereof. For a review, see *Science* 282:63-68 (1998). Combinatorial libraries are composed of large numbers of peptides, oligonucleotides, or organic compounds as a mixture. They are relatively easy to prepare by traditional automated synthesis methods, PCR, cloning, or proprietary synthetic methods. Of particular interest are peptide and oligonucleotide combinatorial libraries. Still other libraries of interest include peptide, protein, peptidomimetic, multiparallel synthetic collection, recombinatorial, and polypeptide libraries. For a review of combinatorial chemistry and libraries created therefrom, see Myers, *Curr. Opin. Biotechnol.* 8:701-707 (1997). Identification of modulators through use of the various libraries described herein permits modification of the candidate "hit" (or "lead") to optimize the capacity of the "hit" to modulate activity.

Still other candidate inhibitors contemplated by the invention-can be designed and include soluble forms of binding partners, as well as binding partners as chimeric, or fusion, proteins. Binding partners as used herein broadly encompasses antibodies, antibody fragments, and modified compounds comprising antibody domains that are immunospecific for the expression product of the identified virulence gene.

Other assays may be used when a binding partner (i.e., ligand) for the virulence gene product is not known, including assays that identify binding partners of the target protein through measuring direct binding of test binding partner to the target protein, and assays that identify binding partners of target proteins through affinity ultrafiltration with ion spray mass spectroscopy/HPLC methods or other physical and analytical methods. Alternatively, such binding interactions are evaluated indirectly using the yeast two-hybrid system described in Fields and Song, *Nature,* 340:245-246 (1989), and Fields and Sternglanz, *Trends in Genetics,* 10:286-292 (1994), both of which are incorporated herein by reference. The two-hybrid system is a genetic assay for detecting interactions between two proteins or polypeptides. It can be used to identify proteins that bind to a known protein of interest, or to delineate domains or residues critical for an interaction. Variations on this methodology have been developed to clone genes that encode DNA-binding proteins, to identify peptides that bind to a protein, and to screen for drugs. The two-hybrid system exploits the ability of a pair of interacting proteins to bring a transcription activation domain into close proximity with a DNA-binding domain that binds to an upstream activation sequence (UAS) of a reporter gene, and is generally performed in yeast. The assay requires the construction of two hybrid genes encoding (1) a DNA-binding domain that is fused to a first protein and (2) an activation domain fused to a second protein. The DNA-binding domain targets the first hybrid protein to the UAS of the reporter gene; however, because most proteins lack an activation domain, this DNA-binding hybrid protein does not activate transcription of the reporter gene. The second hybrid protein, which contains the activation domain, cannot by itself activate expression of the reporter gene because it does not bind the UAS. However, when both hybrid proteins are present, the noncovalent interaction of the first and second proteins tethers the activation domain to the UAS, activating transcription of the reporter gene. When the virulence gene product (the first protein, for example) is already known to interact with another protein or nucleic acid, this assay can be used to detect agents that interfere with the binding interaction. Expression of the reporter gene is monitored as different test agents are added to the system; the presence of an inhibitory agent results in lack of a reporter signal.

When the function of the virulence gene product is unknown and no ligands are known to bind the gene product, the yeast two-hybrid assay can also be used to identify proteins that bind to the gene product. In an assay to identify proteins that bind to the first protein (the target protein), a large number of hybrid genes each encoding different second proteins are produced and screened in the assay. Typically, the second protein is encoded by a pool of plasmids in which total cDNA or genomic DNA is ligated to the activation domain. This system is applicable to a wide variety of proteins, and it is not even necessary to know the identity or function of the second binding protein. The system is highly sensitive and can detect interactions not revealed by other methods; even transient interactions may trigger transcription to produce a stable mRNA that can be repeatedly translated to yield the reporter protein.

Other assays may be used to search for agents that bind to the target protein. One such screening method to identify direct binding of test ligands to a target protein is described in U.S. Pat. No. 5,585,277, incorporated herein by reference. This method relies on the principle that proteins generally exist as a mixture of folded and unfolded states, and continually alternate between the two states. When a test ligand binds to the folded form of a target protein (i.e., when the test ligand is a ligand of the target protein), the target protein molecule bound by the ligand remains in its folded state. Thus, the folded target protein is present to a greater extent in the presence of a test ligand which binds the target protein, than in the absence of a ligand. Binding of the ligand to the target protein can be determined by any method which distinguishes between the folded and unfolded states of the target protein. The function of the target protein need not be known in order for this assay to be performed. Virtually any agent can be assessed by this method as a test ligand, including, but not limited to, metals, polypeptides, proteins, lipids, polysaccharides, polynucleotides and small organic molecules.

Another method for identifying ligands for a target protein is described in Wieboldt et al., *Anal Chem.,* 69:1683-1691 (1997), incorporated herein by reference. This technique screens combinatorial libraries of 20-30 agents at a time in solution phase for binding to the target protein. Agents that bind to the target protein are separated from other library components by centrifugal ultrafiltration. The specifically selected molecules that are retained on the filter are subsequently liberated from the target protein and analyzed by HPLC and pneumatically assisted electrospray (ion spray) ionization mass spectroscopy. This procedure selects library components with the greatest affinity for the target protein, and is particularly useful for small molecule libraries.

The inhibitors/binders identified by the initial screens are evaluated for their effect on virulence in in vivo mouse models of *P. multocida* infections. Models of bacteremia, endocarditis, septic arthritis, soft tissue abscess, or pneumonia may be utilized. Models involving use of other animals are also comprehended by the invention. For example, rabbits can be challenged with a wild type *P. multocida* strain before or after administration of varying amounts of a putative inhibitor/binder compound. Control animals, administered only saline instead of putative inhibitor/binder compound provide a standard by which deterioration of the test animal can be determined. Other animal models include those described in the *Animal and Plant Health Inspection Service*, USDA, Jan. 1, 1994 Edition, sctn. 113.69-113.70; Panciera and Corstvet, *Am. J. Vet. Res.* 45:2532-2537; Ames, et al., *Can. J. Comp. Med.* 49:395-400 (1984); and Mukkur, *Infection and Immunity* 18:583-585 (1977). Inhibitors/binders that interfere with bacterial virulence are can prevent the establishment of an infection or reverse the outcome of an infection once it is established.

Any adjuvant known in the art may be used in the vaccine composition, including oil-based adjuvants such as Freund's Complete Adjuvant and Freund's Incomplete Adjuvant, mycolate-based adjuvants (e.g., trehalose dimycolate), bacterial lipopolysaccharide (LPS), peptidoglycans (i.e., mureins, mucopeptides, or glycoproteins such as N-Opaca, muramyl dipeptide [MDP], or MDP analogs), proteoglycans (e.g., extracted from *Klebsiella pneumoniae*), streptococcal preparations (e.g. OK432), Biostim™ (e.g., 01K2), the "Iscoms" of EP 109 942, EP 180 564 and EP 231 039, aluminum hydroxide, saponin, DEAE-dextran, neutral oils (such as miglyol), vegetable oils (such as arachis oil), liposomes, Pluronic polyols, the Ribi adjuvant system (see, for example GB-A-2 189 141), or interleukins, particularly those that stimulate cell mediated immunity. An alternative adjuvant consisting of extracts of Amycolata, a bacterial genus in the order Actinomycetales, has been described in U.S. Pat. No. 4,877,612. Additionally, proprietary adjuvant mixtures are commercially available. The adjuvant used will depend, in part, on the recipient organism. The amount of adjuvant to administer will depend on the type and size of animal. Optimal dosages may be readily determined by routine methods.

The vaccine compositions optionally may include vaccine-compatible pharmaceutically acceptable (i.e., sterile and non-toxic) liquid, semisolid, or solid diluents that serve as pharmaceutical vehicles, excipients, or media. Any diluent known in the art may be used. Exemplary diluents include, but are not limited to, polyoxyethylene sorbitan monolaurate, magnesium stearate, methyl- and propylhydroxybenzoate, talc, alginates, starches, lactose, sucrose, dextrose, sorbitol, mannitol, gum acacia, calcium phosphate, mineral oil, cocoa butter, and oil of the obroma.

The vaccine compositions can be packaged in forms convenient for delivery. The compositions can be enclosed within a capsule, caplet, sachet, cachet, gelatin, paper, or other container. These delivery forms are preferred when compatible with entry of the immunogenic composition into the recipient organism and, particularly, when the immunogenic composition is being delivered in unit dose form. The dosage units can be packaged, e.g., in tablets, capsules, suppositories or cachets.

The vaccine compositions may be introduced into the subject to be immunized by any conventional method including, e.g., by intravenous, intradermal, intramuscular, intramammary, intraperitoneal, or subcutaneous injection; by oral, sublingual, nasal, anal, or vaginal, delivery. The treatment may consist of a single dose or a plurality of doses over a period of time.

The invention also comprehends use of an attenuated bacterial strain of the invention for manufacture of a vaccine medicament to prevent or alleviate bacterial infection and/or symptoms associated therewith. The invention also provides use of inhibitors of the invention for manufacture of a medicament to prevent or alleviate bacterial infection and/or symptoms associated therewith.

The present invention is illustrated by the following examples. Example 1 describes constructions of *P. multocida* mutants. Example 2 relates to screening for *P. multocida* mutants. Example 3 addresses methods to determine virulence of the *P. multocida* mutants. Example 4 describes cloning of *P. multocida* virulence genes. Example 5 addresses identification of genes in other species related to *P. multocida* virulence genes. Example 6 describes construction of *A. pleuropneumoniae* mutants. Example 7 addresses screening for attenuated *A. pleuropneumoniae* mutants. Example 8 relates to identification of *A. pleuropneumoniae* virulence genes. Example 9 describes competition challenge of *A. pleuropneumoniae* mutants and wild type bacteria. Example 10 characterizes *A. pleuropneumoniae* genes identified. Example 11 addresses efficacy of *A. pleuropneumoniae* mutant to protect against wild type bacterial challenge.

EXAMPLE 1

Construction of a Library of Tagged-Transposon *P. multocida* Mutants

A library of tagged-transposon mutants was constructed in parental vector pLOF/Km [Herrero, et al., *J Bacteriol.* 172: 6557-67 (1990)] which has previously been demonstrated to be functional and random in *P. multocida* [Lee, et al., *Vet Microbiol.* 50:143-8 (1996)]. Plasmid pLOF/Km was constructed as a modification of suicide vector pGP704 and included a transposase gene under control of the Tac promoter as well as the mini-Tn10 transposable element encoding kanamycin resistance. Plasmid pTEF-1 was constructed as described below by modifying pLOF/Km to accept sequence tags which contained a semi-random $[NK]_{35}$ sequence.

Plasmid pLOF/Km was first modified to eliminate the unique KpnI restriction site in the multiple cloning region and then to introduce a new KpnI site in the mini-Tn10 region. The plasmid was digested with KpnI and the resulting overhanging ends Were filled in with Klenow polymerase according to manufacturer's suggested protocol. Restriction digests and ligations described herein were performed according to manufacturer's suggested protocols (Gibco BRL, Gaithersburg, Md. and Boehringer Mannheim, Indianapolis, Ind.). The blunt end product was self-ligated to produce a plasmid designated pLOF/Km-KpnI which was transformed into *E. coli* DH5 alpha:.lamda.pir for amplification. *E. coli* DH5α: (λpir Φ80dlacZΔM15, recA1, endA1, gyrA96, thi-1, hsdR17 ($r_k-$, $m_k-$, supE44, relA1, deoR, Δ(lacZYA-argF)U169, was propagated at 37° C. in Luria-Bertani (LB) medium. Plasmids were prepared using QIAGEN SpinPreps from QIAGEN Inc. (Santa Clarita, Calif.) and digested with SfiI which cuts at a unique site within the mini-Tn10 transposable element. A SfiI-KpnI-SfiI adaptor was prepared by annealing oligonucleotides TEF1 (SEQ ID NO: 86) and TEF3 (SEQ ID NO: 87) and the resulting double-stranded adapter was ligated into the SfiI site to create plasmid pTEF-1. Oligonucleotides TEF1 and TEF3 (as well as all other oligonucleotides described herein) were synthesized by Genosys Biotechnologies (The Woodlands, Tex.).

```
TEF1
5'-AGGCCGGTACCGGCCGCCT        SEQ ID NO: 86

TEF3
5'-CGGCCGGTACCGGCCTAGG        SEQ ID NO: 87
```

Unique sequence tags for insertion into the KpnI site of pTEF-1 were prepared as follows. PCR was carried out to generate double stranded DNA tags using a GeneAmp XL PCR Kit (PE Applied Biosystems, Foster City, Calif.) under conditions including 250 µM each dNTP, 1.5 mM Mg(OAc)$_2$, 100 pmol each primer TEF14 (SEQ ID NO: 88) and TEF15 (SEQ ID NO: 89), 1 ng TEF26 (SEQ ID NO: 90) as template DNA and 2.5 units recombinant Tth DNA Polymerase XL.

```
TEF14
5'-CATGGTACCCATTCTAAC                SEQ ID NO: 88

TEF15
5'-CTAGGTACCTACAACCTC                SEQ ID NO: 89

TEF26                                SEQ ID NO: 90
5'-CTAGGTACCTACAACCTCAAGCTT-[NK]₃₅-
AAGCTTGGTTAGAATGGGTACCATG
```

Reaction conditions included an initial incubation at 95° C. for one minute, followed by thirty cycles of 30 seconds at 95° C., 45 seconds at 45° C., and 15 seconds at 72° C., followed by a final incubation at 72° C. for two minutes. The PCR products were digested with KpnI and purified using a QIAGEN Nucleotide Removal Kit (QIAGEN, Inc., Chatsworth, Ga.) according to the manufacturer's suggested protocol. The unique tag sequences were ligated into the mini-Tn10 element of linearized pTEF-1, previously digested with KpnI and dephosphorylated with calf intestinal alkaline phosphatase (Boehringer Mannheim) using standard procedures. The resulting plasmid library was transformed into *E. coli* DH5α:λpir. Colony blot analysis was performed according to the DIG User's Guide (Boehringer-Mannheim) with hybridization and detection performed as follows.

Hybridizations were essentially performed according to the Genius Non-Radioactive User's Guide (Boehringer Mannheim Biochemicals), the product sheet for the DIG-PCR labeling kit (Boehringer Mannheim Biochemicals), and the product sheet for CSPD (Boehringer Mannheim Biochemicals). For preparation of probes, a 100 µl primary PCR reaction was set up using Amplitaq PCR buffer (PE Applied Biosystems), 200 µM dNTPs, 140 pmol each of primers TEF5 (SEQ ID NO: 91) and TEF6 (SEQ ID NO: 92), 2 mM MgCl$_2$, 2.5 units Amplitaq (PE Applied Biosystems) and 1 ng of plasmid DNA.

```
TEF5
5'-TACCTACAACCTCAAGCT         SEQ ID NO: 91

TEF6
5'-TACCCATTCTAACCAAGC         SEQ ID NO: 92
```

Cycle conditions included an initial incubation at 95° C. for two minutes, followed by 35 cycles of 95° C. for 30 seconds, 50° C. for 45 seconds, 72° C. for 15 seconds and a final incubation at 72° C. for three minutes. The amplification products were separated using electrophoresis on a 2%-3:1 NuSieve GTG (FMC BioProducts, Rockland, Me., USA): Agarose gel and the 109 bp product was excised and purified. Gel extractions were carried out using a QIAGEN Gel Extraction kit (QIAGEN). Approximately 15 ng of the primary product was labeled in a 50 µl PCR reaction using the DIG PCR Kit, 50 pmol each of primers TEF24 and TEF25, and a 1:1 mix of DIG Probe Synthesis Mix with 2 mM dNTP stock solution.

```
TEF24
5'-TACCTACAACCTCAAGCTT        SEQ ID NO: 93

TEF25
5'-TACCCATTCTAACCAAGCTT       SEQ ID NO: 94
```

PCR conditions included an initial incubation at 95° C. for four minutes, followed by 25 cycles of 95° C. for 30 seconds, 50° C. for 45 seconds, 72° C. for 15 seconds and a final incubation at 72° C. for three minutes. The labeled PCR product was digested with HindIII in a total reaction volume of 90 µl and purified from the constant primer arms using a 2%-3:1 NuSieve GTG (FMC BioProducts):Agarose gel. The region containing the labeled variable tag was excised and the entire gel slice was dissolved and denatured in 10 ml of DIG EasyHyb at 95° C. for ten minutes.

Dot blots were prepared using a Hybond®-N⁺ membrane (Amersham-Pharmacia Biotech). Target DNA for each tag was prepared in 96 well plates using approximately 30 ng of PCR product. An equal volume of 0.1 N NaOH was added to denature the sample and each sample was applied to the membrane with minimal vacuum using a Minifold I™ Dot-Blot Apparatus from Schleicher and Schuell (Keene, N.H., USA). Each well was washed with 150 µl of Neutralization Solution (0.5 M Tris/3 M NaCl, pH 7.5) and 150 µl of 2×SSC. Membranes were UV-crosslinked in a Stratalinker (Stratagene, La Jolla, Calif., USA) and prehybridized for one hour in 20 mls DIG EasyHyb Buffer at 42° C. The denatured probe was added and hybridization carried out overnight at 42° C. The membrane was washed two times in 2×SSC containing 0.1% SDS for five minutes each wash. Two high stringency washes were performed in 50 ml of pre-warmed 0.1×SSC buffer containing 0.1% SDS at 68° C. for 15 minutes before proceeding with standard Genius Detection protocols (Genius Manual).

It is desirable to use a non-radioactive detection system for safety, lower cost, ease of use, and reduction of hazardous materials. In initial experiments using similar procedures previously described [Mei, et al., *Mol. Microbiol.* 26:399-407 (1997)], unacceptable background levels of hybridization were obtained in negative controls. In order to decrease background, tag length was increased by 30 bp to a total of 70, amplification primers were lengthened to include all sequence flanking the variable region, a lower concentration of dig-dUTP was used, and the conserved sequences flanking the sequence tag region were removed by gel purification. Most significantly, PCR was used to generate [NK]$_{35}$ sequence tags as the target DNA in dot blots rather than the entire plasmids containing the tagged transposons after detecting background hybridization from the transposon itself Using these modifications background was eliminated making chemiluminescent/non-radioactive screening more effective.

Approximately four hundred different transformants resulting from the ligation of pTEF-1 with the PCR generated sequence tags were screened by colony blot and the 96 strongest hybridizing colonies were assembled into microtiter plates for further use. Even though the likelihood of duplicated tags was very low, half of the plate of master tags was probed against the other to confirm that no tags were duplicated. The plasmids containing these tags were purified and transformed into E. coli S17-1:λpir(pir, recA, thi, pro, hsd, (r−m+), RP4-2, (Tc::Mu), (Km::Tn7), [TmpR], [SmR]), and the transformed bacteria propagated at 37° C. in Luria-Bertani (LB) medium. Each of the 96 E. coli S17-1:λpir transformants containing the tagged plasmid pTEF-1 was used in conjugative matings to generate transposon mutants of P. multocida. P. multocida strain TF5 is a spontaneous nalidixic acid resistant mutant derived from UC6731, a bovine clinical isolate. P. multocida strains were grown on brain heart infusion (BHI) media (Difco Laboratories, Detroit, Mich., USA) at 37° C. and in 5% $CO_2$ when grown on plates. Matings were set up by growing each E. coli S 17-1:λpir/pTEF1:[NK]$_{35}$ clone and the TF5 strain to late log phase. Fifty µl of culture for each tagged-pTEF-1 clone, was mixed with 200 µl of the TF5 culture and 50 µl of each mating mixture was spotted onto 0.22 ™ filters previously placed on BHI plates containing 100 mM IPTG and 10 mM $MgSO_4$. Following overnight incubation at 37° C. with 5% $CO_2$, mating mixtures were washed off of each filter into 3 ml of PBS and 25 µl of each was plated onto BHIN$^{50}$K$^{100}$ plates. Following selective overnight growth, colonies were assembled into microtiter plates by toothpick transfer into 200 µl BHIN$^{50}$K$^{50}$ making sure that each well in a microtiter plate always contained a transposon mutant with the same sequence tag. Following overnight growth, 50 µl of 75% glycerol was added to each well and plates were stored frozen at −80° C.

Nineteen pools were assembled by transferring the transposon mutants to microtiter plates making sure that each well contained a transposon mutant with the appropriate tag for that well. In other words, a specific well in each microtiter plate always contained a transposon mutant with the same sequence tag even though the location of the transposon within those mutants may be different.

EXAMPLE 2

Murine Screening for Attenuated P. multocida Mutants

Nineteen pools of Pasteurella multocida transposon mutants were screened using a murine model of septicemia. Frozen plates of pooled *P. multocida* transposon mutants were removed from −80° C. storage and subcultured by transferring 10 μl from each well to a new 96 well round bottom plate (Corning Costar, Cambridge, Mass., USA) containing 200 μl of brain heart infusion (DIFCO) with 50 μg/ml nalidixic acid (Sigma) and 50 μg/ml kanamycin (Sigma) ($BHIN^{50}K^{50}$). Plates were incubated without shaking overnight at 37° C. in 5% $CO_2$. Overnight plates were subcultured by transferring 10 μl from each well to a new flat bottomed 96-well plate (Corning Costar) containing 100 μl of BHI per well and incubating at 37° C. with shaking at approximately 150 rpm. The $OD_{540}$ was monitored using a micro-titer plate reader. At an $OD_{540}$ of approximately 0.2 to 0.25, each plate was pooled to form the "input pool" by combining 100 μl from each of the wells of the micro-titer plate. The culture was diluted appropriately in BHI to doses of approximately $10^4$, $10^5$, $10^6$ CFU/ml and 0.2 ml of each dilution was used to infect female 14-16 g BALB/c mice by intraperitoneal administration. At two days post-infection, one or two surviving mice were euthanized and the spleens harvested. The entire spleen was homogenized in 1.0 ml sterile 0.9% saline. Dilutions of the homogenate from 10 −2 to 10 −5 were prepared and plated onto $BHIN^{50}K^{50}$ plates. Following overnight growth, at least 20,000 colonies were pooled in 10 mls BHI broth to form the "recovered pool" and 0.5 ml of the recovered pool was centrifuged at 3,500×g and the pellet used to prepare genomic DNA according to a previously described protocol [Wilson, In F. M. Ausubel, et al., (ed.), *Current Protocols in Molecular Biology*, vol. 1. John Wiley and Sons, New York, p. 2.4.1-2.4.5. (1997)].

Initial experiments with virulent wild-type *P. multocida* indicated that organisms could be recovered from the spleen, lungs, kidneys, and liver indicating a truly septicemic model of infection. Dot blots for both the "input" and "recovered" pools were performed as described in Example 1 and evaluated both by visual inspection and by semi-quantitative analysis. Hybridization was carried out as described in Example 1 except that 5 μg of genomic DNA from input and recovered pools was used as template. Semi-quantitative analysis indicates whether a significant reduction in a single clone has occurred. If a mutant is unable to survive within the host, then the recovered signal should be very low compared to the input signal yielding a high input/recovered ratio. Most mutants will grow as well in vivo as in vitro and therefore a ratio of their signals should be approximately equal to 1. Clones selected by quantitative analysis as being highly reduced in the recovered pool were selected for further study. Additional clones with questionable input/recovered ratios were also selected after visually evaluating films made from the dot blots.

EXAMPLE 3

Determination of Virulence for *P. multocida* Candidate Mutants

Each potential mutant which exhibited reduced recovery from splenic tissue was isolated from the original pool plate and used individually in a challenge experiment to verify and roughly estimate the attenuation caused by the transposon mutation. Individual candidate mutants from in vivo screens were grown on Sheep Blood Agar plates overnight in 5% $CO_2$ at 37° C. Approximately six colonies of each mutant were inoculated into BHI broth and allowed to grow for six hours, Dilutions were prepared and five mice each were infected as described above with $10^2$, $10^3$, $10^4$ and $10^5$ CFU each. Attenuation was determined by comparing mortality after six days relative to the wild type. Surviving mice were presumed to be protected and then challenged with a dose of wild type *P. multocida* at a concentration approximately 200-fold greater than the $LD_{50}$ for the wild type strain. Survival rate was then determined for each challenged group of mice.

Results indicated that 62 of 120 potential transposon mutants were attenuated having an approximate $LD_{50}$ of at least. 10 fold higher than the wild type strain. The clones and their approximate $LD_{50}$ values are listed in Table 1. A control experiment with the wild type strain was run in parallel with each set of challenges and in all cases mortality in wild type-challenged groups was 100%.

In addition to $LD_{50}$ values, Table 1 also provides data from vaccination and challenge experiments. Briefly, groups of mice (n=5 to 10) were vaccinated by intraperitoneal injection with the individual *P. multocida* strains shown in Table 1 at a dose that was approximately 200 times greater than the $LD_{50}$ of the virulent, wild type strain. Animals were observed for 28 days after which mortality figures were calculated.

TABLE 1

*P. multocida* Virulence Genes

| Nucleotide SEQ ID NO: | Representative Isolate | Possible Gene Function | Vaccination # survivors/total | Challenge # survivors/total | LD$_{50}$ |
|---|---|---|---|---|---|
| — | wild type | — | 0/10 | — | <10 |
| 23 | PM1B1 | guaB | 10/10, 10/10, 10/10 | 9/10, 9/10 | 4.3 × 10E6 |
| 11 | PM1D1 | dsbB | 10/10, 5/10 | 10/10, 5/5 | 8.4 × 10E4 |
| 3 | PM1BD7 | atpG | 5/5, 10/10 | 10/10 | >3 × 10E5 |
| 74 | PM1BE11 | yhcJ (HI0145) | 10/10 | 5/10 | >2 × 10E5 |
| 70 | PM1BF6 | yabK (HI1020) | 3/5, 8/10 | 9/9 | >2 × 10E5 |
| 19 | PM2G8 | fhaC | 4/5, 9/10 | 9/9 | >4 × 10E5 |
| 76 | PM3C9 | yiaO (HI0146) | 3/5 | | >6 × 10E5 |
| 118 | PM3G11 | UnkO | 4/5, 10/10 | 10/10 | >3 × 10E5 |
| 31 | PM7B4 | iroA (UnkB) | 0/5 | | |
| 17 | PM4C6 | fhaB (fhaB2) | 2/5, 10/10, 9/10 | 10/10, 9/9 | >3 × 10E6 |
| 9 | PM4G10-T9 | dnaA | 4/5 | | >5 × 10E5 |
| 1 | PM4D5-T5 | atpB | 5/5 | | >4 × 10E5 |
| 53 | PM4D5-T1 | UnkC2 | 5/5 | | >4 × 10E5 |
| 15 | PM4F2 | fhaB (fhaB1) | 3/5, 6/10, 10/10 | 6/6, 10/10 | >3 × 10E5 |
| 41 | PM5F7 | mreB | 4/5 | | 1 × 10E3 |
| 7 | PM5E2 | devB | 0/5, 3/10 | 2/3 | ? |
| 68 | PM6H5-T1 | xylA | 5/5 | | >3 × 10E5 |
| 78 | PM6H8 | yigF (HI0719) | 5/5, 9/10 | 9/9 | >3 × 10E5 |
| 108 | PM7D12 | pnp | 5/5, 9/10 | 9/9 | |
| 51 | PM8C1R1-T2 | UnkC1 | 5/5 | | ~6 × 10E5 |
| 37 | PM8C1-T3 | mglB | 5/5 | | ~6 × 10E5 |
| 58 | PM8C1R1-T6 | UnkD1 | 5/5 | | ~6 × 10E5 |
| 45 | PM10H7 | purF (HI1207) | 3/5, 8/10, 8/10 | 8/8, 8/8 | >3 × 10E5 |
| 25 | PM10H10-T2 | HI1501 | 5/5 | | >1 × 10E4 |
| 72 | PM11G8-T2 | ygiK | 5/5 | | >2.4 × 10E3 |
| 21 | PM11G8-T4 | greA | 5/5 | | >2.4 × 10E3 |
| 84 | PM12H6 | yyam (HI0687) | 3/5, 0/10 | | ~2.2 × 10E3 |
| 33 | PM15G8-T2 | kdtB | 5/5 | | >1.2 × 10E5 |
| 116 | PM15G8-T1 | UnkK | 5/5 | | >1.2 × 10E5 |
| 104 | PM16G11-T1 | hmbR | 3/5 | | >1.9 × 10E5 |
| 29 | PM16G11-T2 | hxuC | 3/5 | | >1.9 × 10E5 |
| 35 | PM16H8 | lgtC | 5/5, 10/10 | 10/10 | >2.4 × 10E5 |
| 80 | PM16H3 | yleA (HI0019) | 5/5, 10/10 | | >2.0 × 10E5 |
| 49 | PM17H6-T1 | sopE | 4/5 | | ~6 × 10E5 |
| 120 | PM17H6 | UnkP | 4/5 | | ~6 × 10E5 |
| 5 | PM18F5-T8 | cap5E | 5/5 | | >2.4 × 10E5 |
| 82 | PM18F5-T10 | yojB (HI0345) | 5/5 | | >2.4 × 10E5 |
| 13 | PM19A1 | exbB | 5/5, 10/10 | 10/10 | >1.2 × 10E5 |
| 112 | PM19D4 | rci | 5/5, 8/10 | 8/8 | ~1.6 × 10E5 |
| 39 | PM20A12 | mioC (HI0669) | 3/5, 8/10 | 8/8 | ~2 × 10E4 |
| 60 | PM20C2 | UnkD2 | 5/5, 10/10 | 10/10 | >8.2 × 10E6 |

EXAMPLE 4

Cloning and Identification of Genes Required for *P. multocida* Virulence

Each transposon mutant which was verified to be attenuated was analyzed further to determine the identity of the disrupted open reading frame. DNA from each mutant was amplified, purified, and digested with restriction enzymes that were known not to cut within the transposon and generally produced 4-8 kb fragments that hybridized with the transposon. Using selection for kanamycin resistance encoded by the transposon, at least one fragment for each transposon mutant was cloned.

Southern hybridization with multiple restriction enzymes was performed for each attenuated mutant using a labeled 1.8 kb MluI fragment from pLOF/Km as a probe to identify a suitably sized fragment for cloning. The mini-Tn10 element and flanking DNA from each mutant was cloned into pUC19 and the flanking sequence determined using internal primers TEF32 and TEF40, primer walking and in some cases universal pUC-19 primers.

```
TEF-32
GGCAGAGCATTACGCTGAC           SEQ ID NO: 95

TEF-40
GTACCGGCCAGGCGGCCACGCGTATTC   SEQ ID NO: 96
```

Sequencing reactions were performed using the BigDye™ Dye Terminator Chemistry kit from PE Applied Biosystems (Foster City, Calif.) and run on an ABI Prism 377 DNA Sequencer. Double stranded sequence for putative interrupted open reading frames was obtained for each clone. Sequencer 3.0 software (Genecodes, Corp., Ann Arbor, Mich.) was used to assemble and analyze sequence data. GCG programs [Devereux, et al., 1997. *Wisconsin Package Version 9.0, 9.0 ed.* Genetics Computer Group, Inc., Madison] were used to search for homologous sequences in currently available databases.

In 37% of the clones that were identified as being attenuated, there were multiple insertions of the mini-Tn10 transposable element. Each insertion including its flanking sequence was cloned individually into pGP704 and mated into the wild-type strain to produce new mutants of *P. multocida*, each carrying only one of the multiple original insertions. Individual mutants were retested individually to determine the insertion responsible for the attenuated phenotype. The nucleotide sequence of the disrupted, predicted open reading frame was determined by sequencing both strands, and the predicted amino acid sequence was used to search currently available databases for similar sequences. Sequences either matched known genes, unknown genes, and hypothetical open reading frames previously sequenced or did not match any previously identified sequence. For those genes having homology to previously identified sequences, potential functions were assigned as set out in Table 1.

EXAMPLE 5

Identification of Related Genes in Other Species

In separate experiments, STM was also performed using *Actinobacillus pleuropneumoniae* (App). One of the App strains contained an insertion in a gene that was sequenced (SEQ ID NO: 97) and identified as a species homolog of the *P. multocida* atpG gene. This result suggested the presence in other bacterial species of homologs to previously unknown *P. multocida* genes that can also be mutated to produce attenuated strains of the other bacterial species for use in vaccine compositions. In order to determine if homologs of other *P. multocida* genes exists in other bacterial species, Southern hybridization was performed on genomic DNA from other species using the *A. pleuropneumoniae* atpG gene as a probe.

*Actinobacillus pleuropneumoniae, Pasteurella haemolytica* (Ph), *P. multocida*, and *Haemophilus somnus* (Hs) genomic DNA was isolated using the CTAB method and digested with EcoRI and HindIII for two hours at 37° C. Digested DNA was separated on a 0.7% agarose gel at 40V in TAE buffer overnight. The gel was immersed sequentially in 0.1 M HCL for 30 minutes, twice in 0.5 M NaOH/1.5 M NaCl for 15 minutes each, and twice in 2.5 M NaCl/1 M Tris, pH 7.5. The DNA was transferred to nitrocellulose membranes (Amersham Hybond $N^+$) overnight using 20×SSC buffer (3 M NaCl/0.3 M sodium citrate). The DNA was crosslinked to the membrane using a UV Stratalinker on autocrosslink setting (120 millijoules). The membrane was prehybridized in 5×SSC/1% blocking solution/0.1% sodium lauroyl sarcosine/0.02% SDS at 50° C. for approximately seven hours and hybridized overnight at 50° C. in the same solution containing a PCR generated atgG probe.

The probe was prepared using primers DEL-1 389 (SEQ ID NO: 98) and TEF-46 (SEQ ID NO: 99) in a with a GeneAmp XL PCR kit in a GeneAmp PCR System 2400. Template was genomic *A. pleuropneumoniae* DNA.

```
DEL-1389
TCTCCATTCCCTTGCTGCGGCAGGG        SEQ ID NO: 98

TEF-46
GGAATTACAGCCGGATCCGGG            SEQ ID NO: 99
```

The PCR was performed with an initial heating step at 94° C. for five minutes, 30 cycles of denaturation t 94° C. for 30 sec, annealing at 50° C. for 30 sec, and elongation at 72° C. for three minutes, and a final extension step at 72° C. for five minutes. The amplification products were separated on an agarose gel, purified using a QIAquick gel purification kit (QIAGEN), and labeled using a DIG-High Primer kit (Boehringer Mannheim). The blot was removed from the hybridization solution and rinsed in 2×SSC and washed two times for five minutes each wash in the same buffer. The blot was then washed two times for 15 minutes each in 0.5×SSC at 60° C. Homologous bands were visualized using a DIG Nucleic Acid Detection Kit (Boehringer Mannheim).

Single bands were detected in *Pasteurella haemolytica, Haemophilus somnus* and *A. pleuropneumoniae* using EcoRI digested DNA. Two bands were detected using EcoRI digested DNA from *Pasteurella multocida.*

EXAMPLE 6

Construction of a Library of Tagged-Transposon *P. multocida* Mutants

Transposon mutagenesis using pLOF/Km has previously been reported to be functional and random in *A. pleuropneumoniae* [Tascon, et al., *J Bacteriol.* 175:5717-22 (1993)]. To construct tagged transposon mutants of *A. pleuropneumoniae*, each of 96 *E. coli* S17-1:λpir transformants containing pre-selected tagged plasmids (pTEF-1:$[NK]_{35}$) was used in conjugative matings to generate transposon mutants of *A. pleuropneumoniae* strain AP225, a serotype 1 spontaneous nalidixic acid resistant mutant derived from an in vivo passaged ATCC 27088 strain. *A. pleuropneumoniae* strains were grown on Brain Heart Infusion (BHI) (Difco Laboratories, Detroit, Mich.) media with 10 μg/ml B-nicotinamide adenine dinucleotide ($V^{10}$), (Sigma, St. Louis, Mo.) at 37° C. and in 5% $CO_2$ when grown on plates. *E. coli* S17-1:λpir (λpir, recA, thi, pro, hsdR($r_k$–,$m_k$+), RP4-2, ($Tc^R$::Mu), ($Km^R$::Tn7), [$TmP^R$], [$Sm^R$]) was propagated at 37° C. in Luria-Bertani (LB) medium. Antibiotics when necessary were used at 100 μg/ml ampicillin (Sigma), 50 μg/ml nalidixic acid ($N^{50}$) (Sigma), and 50 ($K^{50}$) or 100 ($K^{100}$) μg/ml of kanamycin (Sigma).

Matings were set up by growing each *E. coli* S17-1:λpir/pTEF1:$[NK]_{35}$ clone and the AP225 strain to late log phase. A 50 μl aliquot of culture for each tagged-pTEF-1 clone was mixed with 150 μl of the APP225 culture, and then 50 μl of each mating mixture was spotted onto 0.22 μM filters previously placed onto $BHIV^{10}$ plates containing 100 μM IPTG and 10 mM $MgSO_4$. Following overnight incubation at 37° C. with 5% $CO_2$, mating mixtures were washed off of each filter into 2 ml of PBS and 200 μl of each was plated onto $BHIV^{10}N^{50}K^{100}$ plates. After selective overnight growth, colonies were assembled into microtiter plates by toothpick transfer into 200 μl $BHIV^{10}N^{50}K^{50}$ making sure that each well in a microtiter plate always contained a transposon mutant with the same sequence tag. Following overnight growth, 50 μl of 75% glycerol was added to each well and plates were stored frozen at −80° C.

APP does not appear to have as much bias towards multiple insertions of the mini-Tn10 element as did *P. multocida*. Only approximately 3% of the mutants were determined to contain multiple insertions, which is in agreement with the 4% previously reported [Tascon, et al., *J Bacteriol.* 175:5717-22 (1993)]. A problem in APP consisted of identifying numerous mutants (discussed below) containing insertions into 23S RNA regions: 28 total mutants with insertions into 13 unique sites. This may indicate that 23S RNA contains preferential insertion sites and that the growth of APP is affected by these insertions enough to result in differential survival within the host. Southern blot analysis using an APP 23S RNA probe suggests that APP may contain only three ribosomal operons as compared to five in *H. influenzae* [Fleischmann, et al., *Science* 269:496-512 (1995)] and seven complete operons in *E. coli* [Blattner, et al., *Science* 277:1453-1474 (1997)]. This site preference and its effect on growth rate may be a significant barrier to "saturation mutagenesis" since a significant number of clones will contain insertions into these rRNAs and large volume screening will be necessary to obtain additional unique attenuating mutations.

EXAMPLE 7

Porcine Screening for Attenuated *A. pleuropneumoniae* Mutants

Twenty pools of *A. pleuropneumoniae* transposon mutants, containing a total of approximately 800 mutants, were screened using a porcine intratracheal infection model. Each pool was screened in two separate animals.

Frozen plates of pooled *A. pleuropneumoniae* transposon mutants were removed from −80° C. storage and subcultured by transferring 20 μl from each well to a new 96 well round bottom plate (Corning Costar, Cambridge, Mass., USA) containing 180 μl of $BHIV^{10}N^{50}K^{50}$. Plates were incubated without shaking overnight at 37° C. in 5% $CO_2$. Overnight plates were then subcultured by transferring 10 μl from each well to a new flat bottomed 96 well plate (Coming Costar) containing 100 μl of $BHIV^{10}$ per well and incubating at 37° C. with shaking at 150 rpm. The $OD_{562}$ was monitored using a microtiter plate reader. At an $OD_{562}$ of approximately 0.2 to 0.25, each plate was pooled to form the "input pool" by combining 100 μl from each of the wells of the microtiter plate. The culture was diluted appropriately in BHI to approximately $2\times10^6$ CFU/ml. For each diluted pool, 4.0 ml was used to infect 10-20 kg SPF pigs (Whiteshire-Hamroc, Albion, Ind.) by intratracheal administration using a tracheal tube. At approximately 20 hours post-infection, all surviving animals were euthanized and the lungs removed. Lavage was performed to recover surviving bacteria by infusing 150 mls of sterile PBS into the lungs, which were then massaged to distribute the fluid. The lavage fluid was recovered, and the process was repeated a second time. The lavage fluid was centrifuged at 450×g for 10 minutes to separate out large debris. Supernatants were then centrifuged at 2,800×g to pellet the bacteria. Pellets were resuspended in 5 mls BHI and plated in dilutions ranging from $10^{-2}$ to $10^{-5}$ onto $BHIV^{10}N^{50}K^{50}$ plates. Following overnight growth, at least 100,000 colonies were pooled in 10 mls BHIbroth to form the "recovered pools". A 0.7 ml portion of each recovered pool was used to prepare genomic DNA by the CTAB method [Wilson, In Ausubel, et al., (eds.), *Current Protocols in Molecular Biology*, vol. 1. John Wiley and Sons, New York, p. 2.4.1-2.4.5 (1997)].

Recovery from the animals routinely was in the $10^8$ CFU range from lung lavage.

Dot blots were performed and evaluated both by visual inspection and by semi-quantitative analysis as described previously. All hybridizations and detections were performed as described. Briefly, probes were prepared by a primary PCR amplification, followed by agarose gel purification of the desired product and secondary PCR amplification incorporating dig-dUTP. Oligonucleotides including TEF5, TEF6, TEF24, TEF25, TEF48 and TEF62, were synthesized by Genosys Biotechnologies (The Woodlands, Tex.). Primers TEF69, TEF65, and TEF66 were also used for inverse PCR reactions and sequencing.

```
TEF69
GACGTTTCCCGTTGAATATGGCTC       SEQ ID NO: 166

TEF65
GCCGGATCCGGGATCATATGACAAGA     SEQ ID NO: 167

TEF66
GACAAGATGTGTATCCACCTTAAC       SEQ ID NO: 168
```

The labeled PCR product was then digested with HindIII to separate the constant primer arms from the unique tag region. The region containing the labeled variable tag was excised and the entire gel slice was then dissolved and denatured in DIG EasyHyb. Dot blots were prepared and detected using the standard CSPD detection protocol. Film exposures were made for visual evaluation, and luminescent counts per second (LCPS) were determined for each dot blot sample. The $LCPS_{input}/LCPS_{recovered}$ ratio for each mutant was used to determine mutants likely to be attenuated.

Clones selected as being present in the input pool but highly reduced in the recovered pool were selected for further study. Additional clones with questionable input/recovered ratios were also selected after visually evaluating films made from the dot blots. A total of 110 clones were selected.

EXAMPLE 8

Identification of *A. pleuropneumoniae* Virulence Genes

A partial flanking sequence was determined for each of the 110 mutants by inverse PCR and direct product sequencing. Inverse PCR was used to generate flanking DNA products for direct sequencing as described above. Sequencing reactions were performed using the BigDye™ Dye Terminator Chemistry kit from PE Applied Biosystems (Foster City, Calif.) and run on an ABI Prism 377 DNA Sequencer. Sequencer 3.0 software (Genecodes, Corp., Ann Arbor, Mich.) was used to assemble and analyze sequence data. GCG programs [Devereux and Haeberli, Wisconsin Package Version 9.0, 9.0 ed. Genetics Computer Group, Inc., Madison (1997)] were used to search for homologous sequences in currently available databases.

Table 2 shows the *A. pleuropneumoniae* genes identified and extent to which open reading frames were determinable. Sequence identification numbers are provided for nucleotide sequences as well as deduced amino acid sequences where located.

TABLE 2

| *A. pleuropneumoniae* Open Reading Frames | |
|---|---|
| Complete Open Reading Frame | |
| atpH | SEQ ID NO: 134 |
| aptG | SEQ ID NO: 132 |
| exbB | SEQ ID NO: 140 |
| OmpP5 | SEQ ID NO: 152 |
| OmpP5-2 | SEQ ID NO: 150 |
| tig | SEQ ID NO: 160 |
| fkpA | SEQ ID NO: 142 |
| hupA | SEQ ID NO: 146 |
| rpmF | SEQ ID NO: 158 |
| Start Codon - NO Stop Codon | |
| lpdA | SEQ ID NO: 148 |
| potD | SEQ ID NO: 156 |
| yaeE | SEQ ID NO: 164 |
| apvC | SEQ ID NO: 128 |

TABLE 2-continued

*A. pleuropneumoniae* Open Reading Frames

| NO Start Codon - Stop Codon | |
|---|---|
| dksA | SEQ ID NO: 136 |
| dnaK | SEQ ID NO: 138 |
| HI0379 | SEQ ID NO: 144 |
| NO Start Codon - NO Stop Codon | |
| pnp | SEQ ID NO: 154 |
| apvA-or 1 | SEQ ID NO: 122 |
| apvA-or 2 | SEQ ID NO: 124 |
| apvB | SEQ ID NO: 126 |
| apvD | SEQ ID NO: 130 |
| RNA or Noncoding Sequences | |
| tRNA-leu | SEQ ID NO: 162 |
| tRNA-glu | SEQ ID NO: 163 |

The putative identities listed in Table 3 (below, Example 9) were assigned by comparison with bacterial databases. The 110 mutants represented 35 groups of unique transposon insertions. The number of different mutations per loci varied, with some clones always containing an insertion at a single site within an ORF to clones containing insertions within different sites of the same ORF. Three multiple insertions were detected in the 110 mutants screened as determined by production of multiple PCR bands and generation of multiple sequence electropherograms.

EXAMPLE 9

Competition Challenge of *A. pleuropneumoniae* Mutants with Wild Type APP225

A representative clone from each of the unique attenuated mutant groups identified above that was absent or highly reduced in the recovered population was isolated from the original pool plate and used in a competition challenge experiment with the wild type strain (AP225) to verify the relative attenuation caused by the transposon mutation. Mutant and wild type strains were grown in BHIV$^{10}$ to an OD$_{590}$ of 0.6-0.9. Approximately 5.0×10$^6$ CFU each of the wild type and mutant strains were added to. 4 mls BHI. The total 4 ml dose was used infect a 10-20 kg SPF pig by intratracheal administration with a tracheal tube. At approximately 20 hours post-infection, all surviving animals were euthanized and the lungs removed. Lung lavages were performed as described above. Plate counts were carried out on BHIV$^{10}$N$^{50}$ and BHIV$^{10}$N$^{50}$K$^{100}$ to determine the relative numbers of wild type to mutant in both the input cultures and in the lung lavage samples. A Competitive Index (CI) was calculated as the [mutant CFU/wild type CFU]$_{input}$/[mutant CFU/wild type CFU]$_{recovered}$.

Of the 35 potential transposon mutants, 22 were significantly attenuated, having a competitive index (CI) of less than 0.2. A transposon mutant that did not seem to be attenuated based on the STM screening results was chosen from one of the pools as a positive control. This mutant had a CI in vivo of approximately 0.6. An in vitro competition was also done for this mutant resulting in a CT of 0.8. The mutant was subsequently determined to contain an insertion between 2 phenylalanine tRNA's.

Competitive indices for unique attenuated single-insertion mutants are listed in Table 3. Competitive indices for atpG, pnp, and exbB App mutants indicated that the mutants were unable to compete effectively with the wild type strains and were therefore attenuated.

TABLE 3

Virulence and Proposed Function of *A. pleuropneumoniae* Mutants

| Mutant | Similarity | Putative or Known Functions | C.I. |
|---|---|---|---|
| AP20A6 | atpH | ATP synthase | .009 |
| AP7F10 | atpG | ATP synthase | .013 |
| AP17C6 | lpdA | dihydrolipoamide dehydrogenase | .039 |
| AP11E7 | exbB | transport of iron compounds | .003, .003, .006 |
| AP3H7 | potD | Spermidine/putrescine transport | .308 |
| AP8H6 | OmpP5 | Adhesin/OmpA homolog | .184 |
| AP18H8 | OmpP5-2 | Adhesin/OmpA homolog | .552 |
| AP13E9 | tig | Peptidyl-prolyl isomerase | .050 |
| AP13C2 | fkpA | Peptidyl-prolyl isomerase | <.001 |
| AP15C11 | pnp | Polynucleotide phosphorylase | .032 |
| AP18F12 | hupA | Histone - like protein | .001 |
| AP20F8 | dksA | Dosage dependent suppressor of dnaK mutations | .075 |
| AP5G4 | dnaK | Heat shock protein - molecular chaperone | .376 |
| AP17C9 | tRNA-leu | Protein Synthesis (gene regulation?) | .059 |
| AP5D6 | tRNA-glu | Protein Synthesis | .055 |
| AP18B2 | rpmF | Protein Synthesis | .112 |
| AP10E7 | yaeA | Unknown | .001 |
| AP19A5 | HI0379 | Unknown | .061 |
| AP10C10 | apvA | Unknown | .157 |
| AP18F5 | apvB | Unknown | .103 |
| AP2A6 | apvC | Unknown | .091 |
| AP2C11 | apvD | Unknown | .014 |

Accuracy of the CI appeared to be very good as the exbB mutant was competed within three different animals yielding CI's of 0.003, 0.003 and 0.006. The use of a Competitive Index number to assign attenuation based upon one competition in a large animal study was further confirmed based on preliminary vaccination results in pigs with 7 mutants (n=8) described below in Example 11.

EXAMPLE 10

Characterization of Attenuated *A. pleuropneumoniae* Virulence Genes

The *A. pleuropneumoniae* genes identified represent four broad functional classes: biosynthetic enzymes, cellular transport components, cellular regulation components and unknowns.

The atpG gene, encoding the F1-γ subunit of the F$_0$F$_1$ H+-ATPase complex, can function in production of ATP or in the transport of protons by hydrolyzing ATP. A related atpG attenuated mutant was also identified in *P. multocida*. Another atp gene, atpH, that encodes the F$_1$ δ subunit was also identified. Phenotypes of atp mutants include non-adaptable acid-sensitivity phenotype [Foster, *J Bacteriol.* 173:6896-6902 (1991)], loss of virulence in *Salmonella typhimurium* [Garcia del Portillo, et al., *Infect Immun.* 61:4489-4492 (1993)] and *P. multocida* (above) and a reduction in both transformation frequencies and induction of competence regulatory genes in *Haemophilus influenzae* Rd [Gwinn, et al., *J Bacteriol.* 179: 7315-20 (1997)].

LpdA is a dihydrolipoamide dehydrogenase that is a component of two enzymatic complexes: pyruvate dehydrogenase and 2-oxoglutarate dehydrogenase. While the relationship to virulence is unknown production of LpdA is induced in *Salmonella typhimurium* when exposed to a bactericidal protein from human which may suggest that this induction may be involved in attempts to repair the outer membrane [Qi, et al., *Mol. Microbiol.* 17:523-31 (1995)].

Transport of scarce compounds necessary for growth and survival are critical in vivo. ExbB is a part of the TonB transport complex [Hantke, and Zimmerman, *Microbiology Letters.* 49:31-35 (1981)], interacting with TonB in at least two distinct ways [Karlsson, et al., *Mol Microbiol.* 8:389-96 (1993), Karlsson, et al., *Mol Microbiol.* 8:379-88 (1993)]. Iron acquisition is essential for pathogens. In this work, attenuated exbB mutants in both APP and *P. multocida* have been identified. Several TonB-dependent iron receptors have been identified in other bacteria [Biswas, et al., *Mol. Microbiol.* 24:169-179 (1997), Braun, *FEMS Microbiol* Rev. 16:295-307 (1995), Elkins, et al., *Infect Immun.* 66:151-160 (1998), Occhino, et al., *Mol Microbiol.* 29:1493-507 (1998), Stojiljkovic and Srinivasan, *J Bacteriol.* 179:805-12 (1997)]. *A. pleuropneumoniae* produces 2 transferrin-binding proteins, which likely depend on the ExbB/ExbD/TonB system, for acquisition of iron. PotD is a periplasmic binding protein that is required for spermidine (a polyamine) transport [Kashiwagi, et al., *J Biol Chem.* 268:19358-63 (1993)]. Another member of the Pasteurellaceae family, *Pasteurella haemolytica*, contains a homologue of potD (Lpp38) that is a major immunogen m convalescent or outer membrane protein vaccinated calves [Pandher and Murphy, *Vet Microbiol* 51:33141 (1996)]. In *P. haemolytica*, PotD appeared to be associated with both the inner and outer membranes. The role of PotD in virulence or in relationship to protective antibodies is unknown although previous work has shown potD mutants of *Streptococcus pneumoniae* to be attenuated [Polissi, et al., Infect. Immun. 66:5620-9 (1998)]

Relatively few "classical virulence factors," such as adhesins or toxins with the exception of homologues to OMP P5 of *Haemophilus influenzae*, were identified. *H. influenzae* OMP P5 is a major outer membrane protein that is related to the OmpA porin family of proteins [Munson, et al., *M Infect Immun.* 61:4017-20 (1993)]. OMP P5 in nontypeable *Haemophilus influenzae* has been shown to encode a fimbrial subunit protein expressed as a filamentous structure [Sirakova, et al., *Infect Immun.* 62:2002-20 (1994)] that contributes to virulence and binding of both mucin and epithelial cells [Miyamoto and Bakaletz, *Microb Pathog.* 21:343-56 (1996), Reddy, et al., *Infect. Immun.* 64:1477-9 (1996), Sirakova, et al., *Infect Immun.* 62:2002-20 (1994)]. A significant finding was identification of two distinct ORF's that appear to encode OMP P5 homologues. This is also the case with two very similar proteins, MOMP and OmpA2 from *Haemophilus ducreyi*. It remains to be determined whether both are functionally involved in the production of fimbriae and whether the presence of two such ORFs represents a divergent duplication with redundant or complementing functions. Interestingly, the two OMP P5 mutants seem to have disparate CT values, suggesting a difference in essentiality or functionality for only one copy. OMP P5 has been shown to undergo molecular variation during chronic infections [Duim, et al., *Infect Immun.* 65:1351-1356 (1997)], however, this appears to be restricted to a single gene undergoing point mutations resulting in amino acid changes rather than "type switching" due to differential expression of multiple genes.

Protein folding enzymes are important accessories for the efficient folding of periplasmic and extracellular proteins, and two genes were identified whose products have peptidyl-prolyl isomerase activity: fkpA and tig (trigger factor). FkpA is a periplasmic protein that is a member of the FK506-binding protein family [Home and Young, *Arch Microbiol.* 163:357-65 (1995); Missiakas, et al., *Mol Microbiol.* 21:871-84 (1996)]. FkpA has been shown to contribute to intracellular survival of *Salmonella typhimurium* [Home, et al., *Infect Immun.* 65:806-10 (1997)) and a *Legionella pneumophila* homolog, mip [Engleberg, et al., *Infect Immun.* 57:1263-1270 (1989)], is responsible for virulence and infection of macrophages [Cianciotto, et al., *J. Infect. Dis.* 162:121-6 (1990); Cianciotto, et al., *Infect. Immun.* 57:1255-1262 (1989)]. Tig, or trigger factor [Crooke and Wickner, Proc. *Natl. Acad. Sci. USA.* 84:5216-20 (1987), Guthrie, and Wickner, *J Bacteriol.* 172:5555-62 (1990), reviewed in Hesterkamp, and Bukau., *FEBS Lett.* 389:32-4 (1996)], is a peptidyl prolyl isomerase containing a typical FKBP region [Callebaut and Momon, *FEBS Lett.* 374:211-215 (1995)], but is unaffected by FK506 [Stoller, et al., *EMBO J.* 14:4939-48 (1995)]. Tig has been shown to associate with the ribosomes and nascent polypeptide chains [Hesterkamp, et al., *Proc Natl Acad Sci USA* 93:443741 (1996), Stoller, et al., *EMBO J.* 14:4939-48 (1995)]. Possible roles include an unknown influence on cell, division [Guthrie, and Wickner, *J Bacteriol.* 172:5555-62 (1990)] in *E. coli*, a role in the secretion and activation of the *Streptococcus pyogenes* cysteine proteinase [Lyon, et al., *EMBO J.* 17:6263-75 (1998)] and survival under starvation conditions in *Bacillus subtilis* [Gothel, et al, *Biochemistry* 37:13392-9 (1998)].

Bacterial pathogens employ many mechanisms to coordinately regulate gene expression in order to survive a wide variety of environmental conditions within the host. Differences in mRNA stability can modulate gene expression in prokaryotes [Belasco and Higgins, *Gene* 72:15-23 (1988)]. For example, rnr (vacB) is required for expression of plasmid borne virulence genes in *Shigella flexneri* [Tobe, et al., *J Bacteriol.* 174:6359-67 (1992)] and encodes the RnaseR ribonuclease [Cheng, et al., *J. Biol. Chem.* 273:14077-14080 (1998)]. PNP is a polynucleotide phosphorylase that is involved in the degradation of mRNA. Null pnp/rnr mutants are lethal, suggesting a probable overlap of function. It therefore is possible that both rnr and pnp are involved in the regulation of virulence gene expression. A pnp mutant of *P. multocida* is a virulent in a mouse septicemic model (Example 2)]. Other pnp-associated phenotypes include competence deficiency and cold sensitivity in *Bacillus subtilis* [Wang and Bechhofer, *J Bacteriol.* 178:2375-82 (1996)].

HupA is a bacterial histone-like protein, which in combination with HupB constitute the HU protein in *E. coli*. Reports have suggested that hupA and hupB single mutants do not demonstrate any observable phenotype [Huisman, et al., *J Bacteriol.* 171:3704-12 (1989), Wada, et al., *J Mol. Biol.* 204:581-91 (1988)], however, hupA-hupB double mutants have been shown to be cold sensitive, sensitive to heat shock and blocked in many forms of site-specific DNA recombination [Wada, et al., *J Mol. Biol.* 204:581-91 (1988), Wada, et al., *Gene.* 76:345-52 (1989)]. One limited data previously indicated that hupA is directly involved in virulence [Turner, et al., *Infect Immun.* 66:2099-106 (1998)]. The mechanism of hupA attenuation remains unknown.

DnaK is a well known and highly conserved heat shock protein involved in regulatory responses to various stressful environmental changes [reviewed in Lindquist and Craig, *Annu Rev Genet.* 22:631-77 (1988)]. DnaK is also one of the most significantly induced stress proteins in *Yersinia enterocolitica* after being phagocytosed by macrophages [Yamamoto, et al., *Microbiol Immunol.* 38:295-300 (1994)] and a *Brucella suis* dnaK mutant failed to multiply within human macrophage-like cells [Kohler, et al., *Mol Microbiol.* 20:701-12 (1996)]. In contrast, another intracellular pathogen, *Listeria monocytogenes*, did not show induction of dnaK after phagocytosis [Hanawa, et al., *Infect Immun.* 63:4595-9 (1995)]. A dnaK mutant of *Vibrio cholera* affected the production of ToxR and its regulated virulence factors in vitro but similar results were not obtained from in vivo grown cells [Chakrabarti, et al., *Infect Immun.* 67:1025-1033 (1999)]. The CI of *A. pleuropneumonia* dnaK mutant was higher than most of the attenuated mutants although still approximately half of the positive control strain.

DksA is a dosage dependent suppressor of filamentous and temperature-sensitive growth in a dnak mutant of *E. coli* [Kang and Craig, *J Bacteriol.* 172:2055-64 (1990)]. There is currently no defined molecular function for DksA, but the gene has been identified as being critical for the virulence of *Salmonella typhimurium* in chickens and newly hatched chicks [Turner, et al., Infect *Immun.* 66:2099-106 (1998)]. In that work, it was noted that the dksA mutant did not grow well with glucose or histidine but did grow well with glutamine or glutamate as the sole carbon source. This observation may indicate that the dksA mutant is somehow impaired in the biosynthesis of glutamate [Turner, et al., *Infect Immun.* 66:2099-106 (1998)].

Three genes were identified that have roles in protein synthesis: tRNA-leu, tRNA-glu and rpmF. Excluding protein synthesis, tRNA's also have a wide variety of functional roles in peptidoglycan synthesis [Stewart, et al., *Nature* 230:36-38 (1971)], porphyrin ring synthesis [Jahn, et al., *Trends Biochem Sci.* 17:215-8 (1992)], targeting of proteins for degradation [Tobias, et al., *Science* 254:1374-7 (1991)], post-translational addition of amino acids to proteins [Leibowitz and Soffer, *B.B.R.C.* 36:47-53 (1969)] and mediation of bacterial-eukaryotic interactions [Gray, et al., *J Bacteriol.* 174:1086-98 (1992), Hromockyj, et al., *Mol Microbiol.* 6:2113-24 (1992)]. More specifically, tRNA-leu is implicated in transcription attenuation [Carter, et al., *Proc. Natl. Acad. Sci.* USA 83:8127-8131 (1986)], lesion formation by *Pseudomonas syringae* [Rich and Willis, *J Bacteriol.* 179:2247-58 (1997)] and virulence of uropathogenic *E. coli* [Dobrindt, et al., *FEMS Microbiol Lett.* 162:135-141 (1998), Ritter, et al., *Mol. Microbiol.* 17:109-21 (1995)]. It is unknown whether the tRNA that we have identified represents a minor species of tRNA-leu in *A. pleuropneumoniae*. Regardless, it is possible that tRNA-leu may have any one of a wide range of functions. RpmF is a ribosomal protein whose gene is also part of an operon containing fatty acid biosynthesis enzymes in *E. coli*. Further work will be required to indicate if this is the case in *A. pleuropneumoniae*, although the same clustering of fab genes and rpmF occurs in *Haemophilus influenzae* [Fleischmann, et al., *Science* 269:496-512 (1995)). The expression of the fab genes is not necessarily dependent on transcripts originating upstream of rpmF as there has been a secondary promoter identified within rpmF [Zhang and Cronan, Jr., *J Bacteriol.* 180:3295-303 The final class of attenuated mutants includes mutations within genes of unknown function or genes that have not been previously identified. Homologs of yaeA and HI0379 have previously been identified in *Escherichia coli* [Blattner, et al., *Science* 277:1453-1474 (1997)] and *Haemophilus influenzae* [Fleischmann, et al., *Science* 269:496-512 (1995)], respectively. The remaining unknowns have been designated *Actinobacillus pleuropneumoniae* virulence genes (apv). The apvC gene shows significant similarity to HI0893, however, the proposed similarity of HI0893 as a transcriptional repressor similar to the fatty acid response regulator Bm3R1 [Palmer, *J Biol Chem.* 273:18109-16 (1998)] is doubtful. The apvD gene is also most similar to a putative membrane protein (b0878) with unknown function from *E. coli* [Blattner, et al., *Science* 277:1453-1474 (1997)]. Two other unknowns, apvA and apvB had no significant matches in the public databases.

EXAMPLE 11

Safety and Efficacy of *A. pleuropneumoniae* Mutants

Nine groups (n=8) of SPF pigs (4-5 weeks old, 3-10 kg) were used to determine the safety and efficacy of seven *A. pleuropneumoniae* mutants as live attenuated vaccine strains. Seven groups were infected intranasally with $10^{10}$ CFU of each mutant on day 1. One group was vaccinated on days 1 and 15 with the commercially available vaccine Pleuromune (Bayer), and one naive group was not vaccinated. On day 29, all groups were challenged intranasally with $1-5 \times 10^5$ CFU per pig of wild type APP225. All surviving animals were euthanized and necropsied on day 42 of the study. Results are shown in Table 4.

TABLE 4

Efficacy of *A. pleuropneumoniae* Mutants

| | % Mortality following intranasal challenge | |
|---|---|---|
| Vaccine | Vaccination | Challenge |
| Pleuromune | 0 | 37.5 |
| exbB | 0 | 0 |
| tig | 12.5 | 0 |
| fkpA | 12.5 | 0 |
| HI0385 | 50.0 | 0 |
| pnp | 0 | 0 |
| yaeE | 0 | 0 |
| atpG | 0 | 0 |
| None | N/A | 50.0 |

The exbB, atpG, pnp, and yaeA mutants caused no mortality when administered at a dosage of $10^{10}$ CFU intranasally. The fkpA and tig mutant groups had one death each and the HI0379 group (highest Apr. 6, 2000CI of the 7 mutants tested shown in Example 9) had four deaths. Wildtype $LD_{50}$ using this model was generally $1 \times 10^7$ CFU, indicating that each of these mutants is at least 100 fold attenuated and that there is a reasonable correlation between CI and attenuation.

Numerous modifications and variations in the invention as set forth in the above illustrative examples are expected to occur to those skilled in the art. Consequently only such limitations as appear in the appended claims should be placed on the invention.

SEQUENCE LISTING (165 sequences)

SEQ ID NO: 1 - DNA, 1112 bp, Pasteurella multocida
  CDS (210)..(1001): atpB
  misc_feature (1099)..(1099): n is a, c, g, or t
  misc_feature (1104)..(1104): n is a, c, g, or t
gtcaacaacattttatggtggagaggccgttaaatttatatccacaatttttttgattgtacttgcttttaaactgttcaattcaatgcattttattgcattttttgttggatattttataacaatagttttaaacaatattcttccattttttataagtaagtacttaaatataaagcattttcataaatatcaataaaggattagttatggcagcagagcttacaacagcgggatatattgggcaccatttagcattcttgaaaacaggggattctttctggcatgttcatttagatacccttctattttcaattatttcaggtgcaatttttctttttgttttttcaaaagttgcaaaaaaagcaacgccgggtgtgcctagcaagatgcaatgttttgttgagataatggttgattggattgatgggatcgtaaaagaaaatttccatggtcctcgtcatgctgttggaccattagcattaactattttctgctgggtattcattatgaatgctatcgatttgatcccagtagatttcctacctcaattagcccatttatttggtattgaatacttaagagctgttccaacagcagatatcagtggaacattaggcttatcaattggtgtcttcttcttaattattttctatacaatcaaatcaaaaggtatgagtggctttgttaaagaatatacgcttcatccttttaatcatcctttgttaattccggttaacttagcgcttgaatcagtcacattattagcaaaacctgtttctttggcgttccgtcttttcgggaatatgtatgcaggtgaacttatctttattcttattgcagtgatgtacatggcaaataattttgcacttaattcaatgggtattttcatgcatttggcttgggctattttccatattcttgtgattaccttacaagcatttatttttatgatgcttacagtggtttatttgagtatgggttataacaaagcagaacactaattttttataaacaaaaccagaccttgggtctaaatttcaatcttatggagaacattatggaacactgtaattactacaacaatcatcgcatctgnaattnttcttgct

SEQ ID NO: 2 - protein, 264 aa, Pasteurella multocida
MAAELTTAGYIGHHLAFLKTGDSFWHVHLDTLLFSIISGAIFLFVFSKVAKKATPGVPSKMQCFVEIMVDWIDGIVKENFHGPRHAVGPLALTIFCWVFIMNAIDLIPVDFLPQLAHLFGIEYLRAVPTADISGTLGLSIGVFFLIIFYTIKSKGMSGFVKEYTLHPFNHPLLIPVNLALESVTLLAKPVSLAFRLFGNMYAGELIFILIAVMYMANNFALNSMGIFMHLAWAIFHILVITLQAFIFMMLTVVYLSMGYNKAEH

SEQ ID NO: 3 - DNA, 1972 bp, Pasteurella multocida
  CDS (364)..(1230): atpG
agcgggccatttggctcagttcggcttcggattcttatgatgcacacgtaagcaattatcacatggtcaaaaagtaactgaattattgaaacaaaaccaatactctccgttatctgtagcacaacaagcattagtgttatttgcagtagagtttggttacttagaagaagtggacttagatcgtattggttcatttgaatcagcacttttagagtatgctaaccataactatgctgattttatgcgtgagttaacccaatctggcaattacaatgatgaaattaaagagtcattaaaaggcattttggatagcttcaaagcaaacagtgcgtggtaagttaacactttaaatggagagacaaaatggcaggtgctaaagagataagaaccaaaatcgcgagtgtaaaaagtacacaaaaaattactaaagcgatggaaatggttgctgcctcgaaaatgcgtaaaacgcaagaacgcatgtcttcttcacgcccttattcagaaacaatacgtaacgtgattagccacgtttccaaagcaacgattggttacaagcatccatttttagtggatcgcgaagtaaaaaaagtgggcatgattgttgtgtccacagatcgtggtctttgtggtggcttaaacgtgaacttgtttaaaactgtattaaatgaaatgaaagaatggaaagaaaaagatgtttccgttcaattgagtttaatcggttctaaatctatcaactttttccaatctttgggaattaaaattttaacccaagattcaggtattggtgatactccctctgttgagcagttaattggttcagtcaattctatgattgatgcttataaaaaaggggaagtagatgttgtgtatttagtttataacaaatttattaacacgatgtcgcaaaagccagtattggaaaaattaattccattaccagaattagataatgatgaattaggcgaaagaaaacaagtttgggattatatttacgaacctgatgcgaaagtattattagataatttattggttcgttatttagaatctcaggtttatcaagcagcagttgaaaaccttgcttctgagcaagccgctcgaatggtcgccatgaaagcagcaacagataacgcaggtaacttaattaatgagttacagttagtctataacaaagctcgtcaagcaagtattacaaatgaattaaatgaaattgttgccggtgcagcagcaatttaacaaatagaggatcggtaatggcaactggaaaaattgtacaaatcatcggtgcggttattgacgttgaattcccacaagatgcagtaccaaaagtatatgatgccttaaatgttgaaacaggtttagtacttgaagttcaacaacaattaggtggtggtgtagttcgctgtatcgcaatgggatcatctgatggattaaaacgcggtttaagcgtaacaaatacgaataacccaatttctgttccagtgggaacgaaaacattgggtcgtatcatgaacgtattgggtgaaccaatcgatgagcaaggtgaaatcggtgcagaagagaattggtctattcaccgtgcgccaccaagttatgaagaacaatctaacagtactgaacttttagaaacgggaattaaagttatcgacttagtttgtccgtttgcgaaagggggtaaagtaggtttattcggtggtgcgggtgtcggtaaaaccgtcaatatgatggaattaatccgtaacatcgcaattgagcactcaggttactctgtctttgcgggggtaggtgagcgtacgcgtgaaggtaacgacttctatcatgagatgaaagactctaacgtattagataaagtgtctcttgtttatggtcaaatgaacgagccaccaggtaaccgtttacgtgtggcattaacaggcttaactatggcggaaaaattccgtgatgaaggtcgtgatgtcttattcttcgttgataa

SEQ ID NO: 4 - protein, 289 aa, Pasteurella multocida
MAGAKEIRTKIASVKSTQKITKAMEMVAASKMRKTQERMSSSRPYSETIRNVISHVSKATIGYKHPFLVDREVKKVGMIVVSTDRGLCGGLNVNLFKTVLNEMKEWKEKDVSVQLSLIGSKSINFFQSLGIKILTQDSGIGDTPSVEQLIGSVNSMIDAYKKGEVDVVYLVYNKFINTMSQKPVLEKLIPLPELDNDELGERKQVWDYIYEPDAKVLLDNLLVRYLESQVYQAAVENLASEQAARMVAMKAATDNAGNLINELQLVYNKARQASITNELNEIVAGAAAI

SEQ ID NO: 5 - DNA, 1357 bp, Pasteurella multocida
  CDS (1)..(813): cap5E
gtcgactatatttatcatgctgccgcattaaagcaagtgccttcatgcgagttttatccgttagaggcagtgaaaaccaatattttaggtacggcaaatgtcttagaagccgccatccaaaaccagataaaacgcgtcgtctgtcttagcacagataaagcggtgtacccaattaatgcgatgggcatttctaaagcaatgatggaaaaagtcatcatcgcaaaatcgcgtaacctagaaggcacaccaacgacaatctgttgtactcgctatggcaatgtcatggcatcgcgtggttcggttatcccattatttgtcgatcaaatacgtcaaggcaagccttttactattactgatcctgagatgacacgctttatgatgacattggaagatgctgtggatttagtcctatatgcatttaaaaatggtcaaaatggtgatgtttttgtacaaaaagcccccgcagcaaccattggtacccttgccaaagcaattaccgaattattatctgtcccaaatcaccctatttccattataggtacgcgtcatggagagaaagcattcgaagctttattaagccgtgaagaaatggttcatgcaattaatgaaggtaattattatcgcatcccagccgatcaacgcagtttaaattacagtaaatatgtcgaaaaaggggaaccaaaaattaccgaagtcaccgactacaactcacataatactgagcgtttgactgtcaaggaaatgaagcagttactgcttaaacttgaattcatacagaaaatgattgagggtgaatacatctcaccggaggtataaaaatgaaagtcttagtaactggttcaaatggttttattgcgaaaaatctgattcagtctttatctgaggaacaagatattgagattttatgttatcaccgtcaatcctctgagaaaacgcttattcatcatgtattgagtgctgattggattattcatcttgcgggtgcgaatcgtccacctgaagaacaagaatttatgacatcaaatacacaattgacggaaaaaatttgccgtattttacagcgtcatcagaaaaaaacgcctttgttatattcctctagcattcaagtagaaagtcccaaaataagtacttattcgcaaaccaaattagaaagtgaatatcatgttcatcaattacataaagaaaatggtaatccgatttatatctgccgtttagctaatgtctttggcaaatggtcacgacctcactataactcggtagtcgccacattttgccataacttaattcatgatttacccatcgaaattcatgatcatactgcagaaataaggctcatttatattgatgatgtcgttga

SEQ ID NO: 6 - protein, 271 aa, Pasteurella multocida
VDYIYHAAALKQVPSCEFYPLEAVKTNILGTANVLEAAIQNQIKRVVCLSTDKAVYPINAMGISKAMMEKVIIAKSRNLEGTPTTICCTRYGNVMASRGSVIPLFVDQIRQGKPFTITDPEMTRFMMTLEDAVDLVLYAFKNGQNGDVFVQKAPAATIGTLAKAITELLSVPNHPISIIGTRHGEKAFEALLSREEMVHAINEGNYYRIPADQRSLNYSKYVEKGEPKITEVTDYNSHNTERLTVKEMKQLLLKLEFIQKMIEGEYISPEV

SEQ ID NO: 7 - DNA, 6132 bp, Pasteurella multocida
  CDS (4032)..(4727): devB
gtcaacaattaccgcactttagtggagtaaataacaatggcgaaaaagaataacgggcatgaaaaagaggatgatgttcgcctagataaatggctttgggctgcccgtttttataaaacacgtactttagcaaaagacatgattgatggcggtaaagtgcattataatgggcagcgcacgaaacccaataaaacggttgaaattggtggtgtgatcaaacttcgtcaaggtaatgacgaaaaagaagtggaagtgcttgcgctttctacgcaacgtcgtggggcgccagaagcacaattgttgtatcaagaaacagaaaaaagccttgaacaacgtgcgaaaatggcgattgcacgtaagattaatgcattaacgatgccgcatcctgatcgtcgcccgaataaaaaagagcggcgtgatttattgaaatttaaacatcaagatagcttttcatcttgatgatgtgatttacctacttttcttattaaagaaaggaatatggggaagctgtgtgcttgcccttaacctgaataaaggctttttatgacagacaacacagacaatgacaaactgtatcgctaccttttccaagatcgcgcggtgcgcggtgaatgggtacggttaaaccaaacgtttactgatacgttaaatacacatcaatatccgaaagtcatccaaaacttgctcggtgaaatgatggtggcgaccagtttattgacggcgacgttaaaatttgaaggggatattactgttcaagtacaaggtgatggaccattaaaattagcattagttaatggcaatcatcagcagcaaattcgcgcattagcgcgtttacaagcggatgtcagtgatgatatgagtttggcgcaattagtcgggaaaggggtattagtgattacgattgcaccgacagaaggcgagcgttaccaaggcgtgattgcgttagataagccaaccattactgcctgtcttgaagattattttgtgcgttcagaacaattgcaaacccagcttattattcgtgctggcgaatttgaaggacaacctgtggcagccggtatgttgttacaaattatgccggacggttcaggttctccagaggattttgaacacttagcaacattggcagcgacggtgaaagaggaagaactatttggtttaacagcagaagaattattgtaccgtttatatcatgaagagcgtgttgaaattttcccttcacagccgatctcatttttctgtggctgctcacaagaacgttctggtgccgcattgttgttgatttctgatgaagaattggatgaagtcttggcagagcataacggtaccattgatatgcagtgtgaatgttgtgggacgcattatttcttcaataaagcagcgattatgcaattgaaagtagaaaaataagtcttggtattatggattttgttgcaggctatcaagatatttgatagcctgtttttcctttgcagcaaacgattttatgagaaaaacgccgtcttctcacacagtagtttaggtattgcatagcatgaagcgggaaactatgtttggcgcttgtctgtttaaaaaggttatctatgttagcactttcaccatcattacttgaaaaaacacttgaaatcgcggatcaagcaggagattttttaacgcgattttataccgactcagggcaaaatgcgttagcaattcaaaccaaacaagataacacgccagtgactgccgtggatttatttttgagtcaatttttaattgaaaaattgaccgcactgacacctgaggtcccgattctttccgaagagagttgtaaaatccccttacaagatcgtgcacattgggcagaatattggttaattgacccactcgatggaacccaacaatttattaatcgcaccgatcaattttccattttgattacacttgtccaacacaatcaacccgtcttaagcattacccatgcccctattttacaaacgacctattatgctatgcagggctttggtgcttacagaaggcagggcaatcaacaagaaaagctaaacaaccaagcgcgacctgagcagcgaaaaatcaaaattgctgtgggagtcgggggcgttgaacggaaaattcagcccttgttaaatccagcttatcaatatgaatttttggtttatggttcaagtggcttaaaaggcggcttagtggccgatggcacttgtgattgctatattcgagtaggaaaaacgggtgaatgggatacgggggcggctgaaatcctcttacgtgaaatgggaggtgctgtgtttgactttgcttttcaaccgcttagctataatcagagagaaagttttattaatcccaattttgtgatggtagcgaatacagaatttgattggcagaaaatttttcaatttcattcgcactaggcattatttattataagatgcgatatcttatgacctctatttttaacaaacggatttcaggaaaaaaatgaaaattgaagcagacaacaattgtattgtaatttttggtgcatcaggtgatttaacttatcgtaaattgattcctgcactgtataacttatataaaatcggtcgtttgactgagcatttctccgtgttaggtgtggcaagaacggaattaagtgatgagggtttccgtgaaaaaatgcgccaagcgttgatcaaaagtgaaaaagcgaatggcgaaacactcgatcaattttgtagccacctttattatcaggcattaaataccgcggatgctgccgattatggcaagttaattcctcgtcttgatgacttacatgataaatatcaaacttgtggtaacacactttactatttatctacgccgccaagcctttatggcgtgattccagaatgccttgcggcacatgggttaaatactgaagagtttggctggaagcggttaattgtggaaaaaccgtttggttatgatatacgcacggcaaaagaactcgatattcaaattcaccgtttctttgatgaacaccaaatttatcgtattgaccactatcttggtaaagaaacggttcaaaatctgcttgtgttgcgtttttctaatggatggtttgaaccactctggaaccgtaatttcattgattatattgaaatcacgggcgcagaatctatcggtgtagaagagcgtggtggttattacgatgattctggcgcaatgcgtgatatgttccaaaaccatttgttgcaagtgttagccatggttgcgatggagccaccagcaattattaatgccgactcaatgcgtgatgaagtggcaaaagtcttgtattgtttacatccattaagtgaggatgacttagaaaatcatttagtcttagggcaatatacggcaggcacagttgaaggtgaagcggttaagggctacttacaggaaaaaggtgtgccggcagagtctaatacggaaacttacatggcattacgttgtgaaattgacaactggcgttgggcgggtgtgccattttatgtgcgtactgggaaacggttaccaagtcgagtgaccgaaattgtgattcatttcaaaaccacaccacatccggtatttagccaaaaagcaccagaaaacaaattaattatccgtattcaacccgatgaagcgatttcgatgcgttttggtttgaaaaaaccgggagcaggttttgaagcaaaagaagtgtcgatggatttccgttatgcggatcttgcctcaccaagcttactgaccgcttatgagcgtttattattggattctatgaaaggcgatgccactttgtttgcgcgtactgatgcggtacatgcctgttggcagtttgtggagccgattttacaatataaagcacaaaatgggcgtgtttatgagtatgaagccggtacttggggaccgacagaagccgacaaactgatcgcgaaaacgggtcgtgtttggcgtaaaccaagtggattaatgaaaaagaaagtgtaatgtccgcctctttcgtaagaaatgcgaggggctaatgtgagcagattgagtaaggaaagatcatgaatacaatcatttttgacagtgcacagcatgccgtagagaaaattgcacaagaattgttagcgtatagcttagaaggtcgccctgtgcatatttccttatccggaggctcaacgccgaaattgttatttaaaactttagctcaagcaccgtataacaccgagattcaatggaaaaatttgcatttttggtggggcgatgatcgtatggtgccaccaaccgatccagaaagtaattacggcgaggtgcaaaaattgttattcgatcatattcagatccctgcagaaaatattcaccgcattcgtggtgaagcccccgttgagagtgaacttcaccgttttgaacaagcgctaagtgcggtcattcctgggcaagtttttgattggattattttgggcatgggaacggacgggcacacggcctcattattcccgcatcaaaccgattttgacgatcctcatttcgccgtgatcgcgaaacaccctgaaacagggcaaattcgtatttcaaaaacagcgaaattgattgaacaagcaaagcgggtgacctatttggtgacaggtagcagtaaagccgagatcttaaaagaaattcaaactactccggcagaacaactgccttatcctgctgcgaaaatcaaagcgaagcatggggtgacggaatggtatttggataaggatgcggcaaaattactgtaatgcgtcgtgagatttttcaacatttttgcaaagagacttgaaacaaaatagaccatagcgttcgttttcaacgagtgctgaaaatgaaggctctcgttgaaaatggcgccatttagtgggtaagcttaaggttcgctcagacagcgctatcaaaagggtaaaagaatgtatcaactctattttaatccaccaaaatcttcatggtcattacgcgtttgggtgttattgaaagaactggcaattccttttgagcctaaaattgtacgttatttggatgatttaagtgaacaacgccaacaatttaaggcgttttcgccgacttcaaaaatcccagtattgcatgctgatggtgttgtcatttgggacagtttagcgattatcgagtttttggcagaaagttatccgcacgtgtgggcgcaagataaggcgacaagagcgtggtcacgttctgcttgtgctgaaatgcactctggctttgaaaatttgcgtgaaatgtgtgatttcgcccctttagctcgcaaaccgttacaagaaatgcccgctgtgttaagccaagagctaacaaggcttaatcaattattagaagaagggttaacaaatcacactgggcgatttaatgcaaacctccagtgcttttggtcgagtacaatcctcgttgtcttttttccgtaattcctatgatgactttgccgcttatcgtgcggtgttaaatcgtttaactggctttcatagcgcgattaaagcggctaatcgcccaagcaaattagtgctcacagaaagtcgtcatgatattggttttcatgatctcaacgtagagaccccgcaaggaaaaaccttaattgacaagctcaacctacaatttcctctcggtacatggttattaattcaaggacattctggtgtagggaaaacaaccttgttaagaaccattgcgggactatggccttatgctagtgggacaattcaacgtccacaacaagatactctgtttctttctcaaaaaccttatttgccacaaggtcgcctacttgatgccctattttatcctgaactggcgcctgaagacgtgaatgagcaacaagttatagacatactcgcgaaagtacaactcgggcatttaagcgataaactagaacaagaaaatgattggacacgggtactctctttaggtgaacaacaacgtctgtcgtttgctcgcattttattgcataaacctactgttgttttcttagatgaagccactgccagcatggatgaaggactggaagatgcgatgtaccgcttactgaaagatgaactgcctcagattactgtgatcagtgttggacaccgttcgacgttaattccgcaccattcacagcaattacacattcaataacaagacagggcgttgtggagtcga

SEQ ID NO: 8 - protein, 232 aa, Pasteurella multocida
MNTIIFDSAQHAVEKIAQELLAYSLEGRPVHISLSGGSTPKLLFKTLAQAPYNTEIQWKNLHFWWGDDRMVPPTDPESNYGEVQKLLFDHIQIPAENIHRIRGEAPVESELHRFEQALSAVIPGQVFDWIILGMGTDGHTASLFPHQTDFDDPHFAVIAKHPETGQIRISKTAKLIEQAKRVTYLVTGSSKAEILKEIQTTPAEQLPYPAAKIKAKHGVTEWYLDKDAAKLL

SEQ ID NO: 9 - DNA, 2438 bp, Pasteurella multocida
  CDS (1635)..(2396): dnaA
gacccaatgcttgccaccggcggctctatgattgcgacaatcgatcttctaaaagcgaaaggctgtaaacacattaaagtgctcgtgttagtcgccgcgcctgaaggcattaaagcattagaagctgcgcaccctgatatcgaattatataccgcatcagttgatagtcacttaaatgaacaaggctatattattccaggtcttggtgatgccggtgataaaatttttggcactaaataatcccaacacaagcggcatcttatgccgcttttttccgttcaatttatagcgcttacaatcttaacagcttgaacactataaaatgaaaagttaattcagacagagagttgaaacttaacatgacaaatcaaaatccccctgttcttctagaacaaaatcacgcaaaacaagccttcgttgggctacaaatgctttttgttgccttcggtgctttagtccttgttcccctgattacgggtttaaatgccaatactgccttattgaccgcagggattgggacactcttattccaactttgtactggacgccaagtcccaattttcttagcctcttcctttgcttttattgcaccaattcaatatggcgtggcaacatggggcattgctactactatgggggggctggtgtttactggactggtttattttgccctcagtacgttagtcaaaattaaaggtgctggtgctttacaaaaagtctttccgccagtagttgttggtcccgttattatcatcatcggtatgggacttgcccctgttgccgtggacatggcattaggtaaaaacagcacttatcaatataacgatgccgtattcgtttcgatggcaacattattgacaacgttaggtgttgcggtgtttgctaaaggcatgatgaaattaattcctatcatgtttggtattgtcgtcggctatatcctctgcttattcttaggcttaattaatttccaacctgtcattgatgcaccttggtttagtgtgccagaaattactacccctgaatttaaattagaagctattctttatttattaccgattgctatcgccccagcagttgagcatgtcggtgggatcatggcaatcagttcggtgacagggaaagacttcctacaaaaaccaggattacatcgcactttattaggggatggtattgcaacgagtgccgcctcattcttaggaggaccacctaatacaacttatgctgaagtcactggtgctgtcatgcttacgcgcaactttaaccctaaaatcatgacatgggcagccgtttgggcaattgcgatttccttctgtggtaaagtcggggctttcctctctaccattccaactattgtcatgggtggcattatgatgttagtgtttggctctatcgccgtagtcggtatgagtacactgatccgtggtaaagtggatgtaacagaagcgcgtaatctgtgtattatttccgttgtgatgacgtttggcatcggtggtatgtttgtgaactttggagaagtctccttaaaagggattagtttatgcgccgttgtcgcgattttactcaacttaatcttacccaaagccaaaaacaccccaatagaagaaaatcgataagagaaaattaagggttaagtcttgcttaacccttcatttttcgtttatccttattctccttttttcgattttgtaggttgctttttgttagaaaatttccaattacctttgcctattcatcaactcgatgatgaaacgctggataatttctatcccgacaataatttattgttgctcaattcgctacgcaaaaattttacttgtctaacacaacaatttttttatatttggggcgagcaaagcagtggtaaaagtcacctcttaaaaggcattactcatcattttttccttttacagcgccccgctatctatgtgcccttagaaaaatcccaatatttctcaccggcggtactcgaaaacttagaacaacaacaattggtttgtttagataatttacaggcaattataggcaatactgaatgggaattagcgatttttgatttatttaatcgcataaaatctgttgaaaatacactgcttgtgatcagtgcaaatcaatccccaactgcattacctgtaagtttacctgacttagcttcacgtttacgctggggagaaagctatcagctggtccccttaaatgatcaacaaaaaatccatgtattgcaaaaaaatgcacatcaacgtggtatcgaactccccgatgaagtagctaattttcttttgaaacgcttagagcgcgatatgaaaacgttatttgaagcactaagtaaattagataaagcatcattacaagcccaacgtaaattaacgattccctttgtaaaagaaattttaaagctataaaaaaagaccacctctttatcaggtgatctttcttgtcga

SEQ ID NO: 10 - protein, 254 aa, Pasteurella multocida
LLNPSFFVYPYSPFFDFVGCFLLENFQLPLPIHQLDDETLDNFYPDNNLLLLNSLRKNFTCLTQQFFYIWGEQSSGKSHLLKGITHHFFLLQRPAIYVPLEKSQYFSPAVLENLEQQQLVCLDNLQAIIGNTEWELAIFDLFNRIKSVENTLLVISANQSPTALPVSLPDLASRLRWGESYQLVPLNDQQKIHVLQKNAHQRGIELPDEVANFLLKRLERDMKTLFEALSKLDKASLQAQRKLTIPFVKEILKL

SEQ ID NO: 11 - DNA, 2060 bp, Pasteurella multocida
  CDS (856)..(1389): dsbB
gaattcttcttacgtatgctcccagtcacgttgccagttctcatttgtggtttagtgacctgcttcttagtggaaaaatttggtgtatttggctatggcgccaaattgccacgtaaagtatggggcatcttggcaaagtttgatcgcaataatcaacaaaaaatgtcacgacaagatcgtttgaaactttttgtgcaagctttaattggtatttggttggttgttggactcgcattccatctcgccgccgtcggtatcattggtttaacggtgattattttggctacttcattttgtggtgtcaccagcgagcatgctattggtaaagcctttcaggaatccttacccttcacagcattgttagtggtgttcttctcggttgttgccgtcatcattgaccaacatctgtttgcgccaattattcagtttgtgctggctgccagtgaacatactcagcttgctcttttctatatttttaacggtttgttatccgccatttcagataatgtgtttgtggccacagtttatatcaatgaaaccaaagcggcattagaggctggcttaattgctcaaccacaatatgaattactggcagtagcaattaataccggtaccaatcttccttctgttgcaaccccaaatggtcaagccgcattcttatttttattgacctcatcactggcaccattaattcgtctttcttatggtagaatggtttatatggcattgccttataccatcgtattatcctgtattggtttattgactgtggaatatattttgcctggcgcaaccaatgtgctcattcaaattggtttattaaaaccaatgtaatgacaagtaaaaggaggaaacatgctaagcttttttaagacactctcaacaaaacgaagtgcatggtttctattgtttagctcagctttactattagaggctatcgctctttattttcaacatggcatggggctcgccccttgtgtcatgtgtatttacgagagggtagctattcttggcattgctttctccggtttattggggttactctacccgagttcgatgcttttgcgccttgtggcgttattaattggtttaagcagtgcaatcaaaggcttaatgattagcatcacccatttagatctacaactttaccctgcaccttggaaacaatgttcagcggtggcagaatttcccgagactttacccttagatcagtggtttcctgcactcttcctcccttcaggctcatgcagtgaagtaacatggcaatttctcggcttttctatggtgcaatggatcgtcgtcatttttgcactctataccttattacttgctctcattttcatcagccaagtcaaacgtctaaaacccaagcagcgcagactctttcattaagtcataaaaaatggtgcgataaagcaccatttttcatttctcgttcggtatagattaaatttcttgcacgacaaactgcagggaatgtcttgctaataatcttgctttacgctgctttaagcgttttaaacgtaatgcgcgtccttgtgataaacgatataatttttttgtcggcttcaaaaagcttttacgtctcgccatactcttcctcttattgtgtcgttacggttgtcgctaacgtatccgtttctttcttgatttcgttgatgttttctatttcggcggcttgtgtatctaatgtttcttcaatttgtgcttgctgtacccgataataatgcacaatgctgttcatataacgacggatattttccacatagtgatatgcttcatagcctcgcgcatacccgtattttaaccccgtgtaatagcgtttttctgctaatagtggcaaattcttcttcacatctaaccaattatcgggatcaccacctaggctcttggttaaacggcgcgcatctaacaaatgccctaatcccatattatacgccgctaaggcaaaccaaatacgctcatcttctttaatcgtatcaggcatttgcgtaataagccaatgtaaatattctgaaccggctttaatactttgttccggatccgttctgtcttgaatt

SEQ ID NO: 12 - protein, 178 aa, Pasteurella multocida
MLSFFKTLSTKRSAWFLLFSSALLLEAIALYFQHGMGLAPCVMCIYERVAILGIAFSGLLGLLYPSSMLLRLVALLIGLSSAIKGLMISITHLDLQLYPAPWKQCSAVAEFPETLPLDQWFPALFLPSGSCSEVTWQFLGFSMVQWIVVIFALYTLLLALIFISQVKRLKPKQRRLFH

SEQ ID NO: 13 - DNA, 4426 bp, Pasteurella multocida
  CDS (2756)..(3211): exbB
gaattcttgacctggtgtgaggcttttattgacttccaccccaattgcgcgttctttcactttattaataaagtcacgtaccactggtaacgccacatccgcttctaataatgccatgcggacttcacgtagcgtttccttaatattgtcatcagttaaacgtccacgtccactaatgttacgtagcgtttttgacaagcgatccgacaaattctcaaacatgcaatcttcctatttaatctcgaaaaaattgccctaattatactgaaatcccatagattttcatcctttgtaataaatttatagcgatttcacagtgagaaagttagaatggacggagaacaaaggtgagggaatttcaatgtggctttcaattttttccgtgtttttttatctattgagtgtcttactcattacccctatgttgttaaaaattcaagcgggcgaacccgcatcggttcccaataggatgccttttttaacggcagcattactcgccattcttctgcactttatcaatcttattcctctttttaccgatttaaccagcggtcaaaatttctcggttatcgaaatcagttccttaatcagtgttatgacagcaacgatcgccacattagcgtttttatttcgcatacacactttatggtttttattaccgattatttattctttcgccatcattaatctggtcctcagtaccttaatgccggcgcattttttatatcatcttaatcaagatatgggcttatttattcatgtaggcttatcactgttgacttattcggtctgttcgattgtcgcgttatattccattcagttagtttggatcgatcgcgccttaaaaaataaaaaactgcctttttcaccaatgattccaccgttaatgaccgtagagcgccatttttttcgtttaatgctgataggtgaaatattactcacgattgtcctcatttcagggagctaccatttatcgaaaacctttgccccacaagacatccagaaagctgttttttctttcttggcttggatagtctttgggagtgcactggttggtcattggaagctccattggcgtggaaaaaaagtggtgtattatgcgcttttaggtatcattctcctgactatcgcctattttggtagtcgtgtaatgcttgaaatataaacaagatttatttatgctacgccatagtaaaagtgcggttcaaaaaacgaaaaaatgaccgcacttttcgatttttgattaactcgcaaaaggatgcattttggacagtattccccttagtaccctctttattacactcatcatcttattgatcatctctgcttatttttcaggctctgaaaccggtttgttgtctgccaatcgttatcgactacgccatttagccgaaaaagggcatagaggtgcgaaaaaagcggaaaaattactgaaaaaaacagatgttttgcttagcctgattttaatttgtaataacttagtcaatattactgcttctgccattaccacgattatcggcatgcgcttatatggcgatgcgggagtcgccattgcaactggggcattaacctttgtgatgcttatttttgccgaaattttgccgaaaactatcgccgcccgttatccagaaaaagtggcattcacgtccagtcatttgttgtccgtttttctgcgactttttaccccgctggtctatttaatgaatttaattattcaggggattttggcactattacgtctaaaatcagataataaatcaacctcattaagcccagaggaattacgttccatcgtaaatgaatcaggtaaatttattccttccgcccaccaagaaatgctgttatctattttggatttagaaggggtcaccgtagatgacattatggtgccacgtaatgacattgggggtattgatattgacgatgattggaaagccattatgcgtcaacttaaccatgcagcgcacgggcgtgttgtactgtataaaggaaatatggatgaaaatattttggggatgttacgtgtacgtgaagcctatcgcttaatgctcgataaaaatgaatttaacaaagaaactttaatccgtgccgccgatgaagtgtattttattcctgaaggtacgccactgaatagccaattattaaatttccgcaacaataaagaaaggattggtttagttgtagatgaatatggtgatattaaaggcttagtcaccttagaagatatcttagaagagattgtcggtgaatttaccacttcaacagccccatcaattaacgatgaagttatcccacaatcagacggttcgcttatcattgagggatccgccaatttacgtgatttgaataaattatttgactggaatctcgataccgaagatgcacgtaccttcaacggcttaattttagagcatttagaagaaattccagaagaaggaacggtatgtgaaattaatgggctacaaatcacgattctagaagtgaatgacaacatgattaaacaagccaaagtcattaaactttaattcaacatctggctaagcgatgtcatcaagacatcgcttttttattccgtacatgaatgtttgatccaacacaacatttattcaacattggataaataatcatcctaaatcgcacgaatttcttatttaccccgtttttggcttttgctagaatcttgcaattgaaattaattctcaataccgtataatgttcaacattattttgcgatacaaattaaaggattattaaaatgccacaattattccaattcttacaacaatatattgattacattattctaggcttacttgccttcatgagctttattatggtttggcttgtgattgaacgctttcttttcttaagtcgcgtcaacgtggcatcttatgaaagcatacatgaattagacattgacttacaacgccacctcacagctatctctacaatcggttctaatgcaccttatgtaggtttgcttggtaccgtcattggtattctcttaactttctatgaattaggtcactccggtggcgatattgatgcggcggccattatggtgcacttatcattagccttaaaagccacagcagtaggtattttagtcgccattcctgcaatggtgtgttacaacggtttaggacgtaaagtcgaagttaatcgtttgaaatggtttgccttaaatgagaaaaaagccaaacaacaagcatagggagccgtcatgaaaaagtttgatgaaatcaacattatcccttttattgacatcatgttggtactattggctatcgttctgattacagcctcttttatttcacaaggtaaaatccaagtgaatgtaccaaaagcaagttcaacagttgcgtttcgttcagatgatttagccaaattgctgactattacggaaagcggtgaaattttttatcacgataaaccgattacgatagaggcattggaacaagaaatcagtaattgggaaaaagatcaaaaagtcaccttgaaggtagatgcaaaatccagtttccaagatttcgtttctatcactgatattatggctaaaaatgaaattaaaaatgtcgctatcgtgacggttaaagaaaaggcatctcaatgatagataaaagtcgttcttgcatcgggtttgcaatttcattgctttttcacgcaagttttgtctctttcctgtattggattgtacaaaaagacgatgacagcgcgaatggatttgctgccgatatcatctcaactcatatttccatggaaatgctggcggctaccgttttagaagaaccagagccggaaccagagccggcgcctccggtagtagaacctgaactgccaaaagaagtagtcgcagatccgacggtaaaacctgagccaccaaaagaacccgaaaaaccaaaagagcctgaaaagccaaaagagaaaccgaaagaaaaaccaaaagaaaagccgaaaaaaccgaagaaagaacaacgtgatttaccaaagtcagatcgccaaattgattctaattcatcgatcaatcaacaagcgaccacaacaggcaacatcacaaccaataatccgaatctggtcggtaaaggtaatagcacagatgaagtcaatgcttatcgctcggctttacgcagagaaattgaaaaacataaacgctatccaaaccgtgcacgcatgatgcgcaaacaaggtgtggtaacaatcacgttccatcttaataatgccggcgtaattagtaatgcgcgaatcagcaaatcttccggctcagaagaattagataacgctgcactggtagctgtcaataatgcccgtccaattggtccactgcctgttggtatgccaaatgaagtgagcgttcctgtcagtttcagaatcacaaattaaaaaagtgcggtaaaatttaccgcacttttttctctctattagaatt

SEQ ID NO: 14 - protein, 152 aa, Pasteurella multocida
MPQLFQFLQQYIDYIILGLLAFMSFIMVWLVIERFLFLSRVNVASYESIHELDIDLQRHLTAISTIGSNAPYVGLLGTVIGILLTFYELGHSGGDIDAAAIMVHLSLALKATAVGILVAIPAMVCYNGLGRKVEVNRLKWFALNEKKAKQQA

SEQ ID NO: 15 - DNA, 6876 bp, Pasteurella multocida
  CDS (534)..(6863): fhaB1
agatgcgtgatctgatccttcaactcagcaaaagttcgatttattcaacaaagccgccgtcccgtcaagtcagcgtaatgtctgccagtgttacaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattgttaaccaagaaaacggtttattccatacactcggtaatatgatgttagaagcagagcgttctgtttataatattggcgatatttatgcgagtaaaaaattaacagttcatactcataatttgattaatgatgtgcgtttatctggcaatgtgagttataagcctatcggttcaagtcgtgattatgatatcagtcgtgttgcggtacatggttggcacaataatgtttataagctcaacttaaatctgcaagaacaagataaaaccgatattaaagttgtgaaaatgggggctatccgttctgatggtgattttgactttaagggaataaaggcgacatcatcagaatcaaaaccgcagttaattaatcatggattaattaatgtcaaaggaacatttaatgcggaagctgatcaagtggtgaaccaaatgaaagcgtttaaccaaaatgcattagcaagcgtgtttaagaatccagcgaaaatcacgatgtactatcaaccacttactcgttatatttggacaccattatcgggtaatgcatcgcgtgaatttaacaatttagagtctttcctcgatgccttgtttggctcaacaacaatcttaaaatcaagtttctatagtacggaaaattttagtgcttatcagcttctatctcatattcagcattcaccaatgtaccaaaaagcgatggcacaagtgtttggtgcagagtggcatagtaaatcctatgatgagatgcgaaacaaatggaaaagctttaaagaaaatccaacagatttcatttattacccatcagaaaaagcaaaaatcctagcgggaaaactagaaggtaagcttacaacgctacaaaatggtgaatatgccgaacgtggtaagtttgatgagagtatccaaattggtaaacaccaattatcgctaccatcagtagagcttaaagcggagtttagtgataaagaacgtttggaagaggacggggtagatttatcctcgatcgccgaactcttagaaatgccaaacttatttattgataatagtatccaattagaaaagaaaaagttgtctcctattgaggatctagatgaagaaccacgtaaaaatctggatatagaagaaagccattctaattcatcggatgacgtgcttagcatgaatgatgatgagtctgatacagacgatagcaagtggagtatgggcaatgatgagaaagagatgcccgatgataagctgggtataagtcgtgatgatcgtggaaataaaccacctcgtactgatcctacagttgattatcttaaccctgatgaattctttgaaaatggttatctcttgaatgagctactacaggagcttggagaagagccgttactaaaagaaggggaagatcattttaaacgttctaccaatctagtccgtctaggcgagagagataggcaaaatagagaaaagagagaaaaagaggggtattttgatctgcctggtacattagatatgaaactgcaggagttattcgaaaaaagaaaacaaaaacacgaagcagaacagaaagcaagaatagaaaaagcacttctacaaaaatcagaacaacaagaaaaacgtgttgaagaacgtaagcaagaggaaaaacgtcaagcgcaagataaaattgctaagcaagtagaaattgcaaaagaaatgcaacgggtagaagaaattcgccagagagaaaaacaacttgcgatccaactgcaagaagaagagaagaaacaacaagaagaaaaacatttatccgaggagaaaaaacaagctgaacagaaacaaaaagctgaggagaaagttgcacaagaaagattagacattgaacaacagaaagcgtatgaagaaatggcgaagcgagaggcagaggcatcaaaaaatgttttattgaaagcgattgatgaagaacgtccaaaagtggaaactgatccacttttccgtacaaaattgaaatatatcaatcaagatgactatgctggtgcaaattatttcttcaataaagttggtttaaatacaaaaggtcatcaaaaagtaaatgtgttaggggataactattttgatcatcaagtgattactcgctcgattgagaaaaaagtagataaccaccttaaccaaaaatacaatctcagcgatgtggaattagttaaacagctgatggacaattccacaacacaagcgcaggagttggatttgaaactaggtgcggcattaactaaagaacaacaagctaacttgacccaagatatcgtttggtatgtcaaaacgaaggtaaagggcaaagatgtgtttgttccaaaggtttatttcgcttctgaaacgctcgtagaagcccaaaaattacaaggtttaggcactgggactatcagagttggtgaagctaagattaaagccaaagatgtggtgaataccgggacattagctgggagaaaactcaatgttgaagcgagtaataaaatcaaaaatcaagggagtatcttaagtactcaagaaacacgtttagtcgggcgtaaaggtattgaaaacgtatctcgttcatttgcaaatgatgaattaggagtcactgcacaacgctcagaaatcaaaacggaaggtcatttacatcttgaaacagataaggattcaactattgatgtacaagcatcggatattaaagcaaaaacaagctttgtgaagactggtgatgtgaatctcaaaaatacatacaatactaaacatgcctaccgtgagaaattctcgccgagtgcactacaagttgcagaacttgatgtggcagggcttaaagtcccacttttaggcgtgtcgtctccatccagttattcagagcatactagtgaggcaacttcagagggatcaatcttcgaagtagggcacttacatcttgcggtagacagagatgtgaaccaagcggggagtaaaattaaggctaagtataccactggtgttgtgaaagggaactttaatactgaagcgggcaagaatattaaacatgtcgaaaaagaagaatatagttcacagctatttgcttcagcacacgcgagtggtggtggcacctcagttcgttatgactataacagccaagatggtggcaatgcctctgttggtgttccgacaaaccatactggagttggggcagaggcaggaatgtcattcacccataccaaagacaaagaaacactgctcactcacaccaatagtgaattacaagtcaaacatgggaaattacatgtgcttggttatgccgatattggtggagtagatattaatactaaactaccagaagatgcacaaagcaaagcacagaaagagatagcggctagcaagccagagaagaccgagcaatctgcacaggatgtggctcaagctcaatcaaatgccaataaggataaggaaaataaagccccagaaataaaagaattatcagaggctgaaatcgcggatctcatgtcagaaaaatcaaaagcgtattttgatgattttgcagagcaagcgaaaaaagcacctgaaaacaatcgatttgaattgtctgcgaaagaaattaagtcgagcaaacaaaaagaccaatatgatcatgagtctgaacggacgacttttaaagttggacctgaagcggaggctcattctgcggttgccgatatggtgagccatttagtgaaagaatatagagatgcacaaaatgggactaaacaagacggtacagtagcattacaacatgctagtgatgtcttaaatattgtgacgggggatttagcggggagttcagctaaattgtctgttgaaagaacacatgagacaaaacgaacgacagaaacgggggatattgttactaagattggtggcaatgtcacactgtcagcacgcagtggtagtgtgaaccttaaaaatgtacaaagtgatgaacaagctaatttgaccttaagagcaaaagaagatgtgaatgtgctgtctggtgaaaaaacacgagaaaccacagaaacagtatcaagacagaaactttctcatggtgtgaacgcaggttgcagtatgatgagtggcgcctgtactgccggtgttagcacatcacttgaaggaaatgaaagctatacgtcagaacgtgaaacggctcaaaataacagtttcttaaaagcacgcaacatgaaagttgaagcaggtcgcgattttaatgttgtcagttcgaatattgatgcagataagctcgatctccacgttaaaggaaaaacgaatgtggtatccaaacaagatacgttacaaaaagtgacgcatggagttgactataatctttccgctggcgttgcactttctagtgcaacaattgctaccccaaccggtaatgttggtttcggttataccaatgagaccgaaagcaagcggacggttaatcaacaagcagggattaaagcgaataaaattacagggcaaacgcatgacttaaatcttgaggggggatatcttgtcagcaacgataaggataatcagctgaaagttaccggcgatgtcacaactaaagcccttcacgatcaacatgataaagatggtggaacatttggtttatctgtgggtatcagtgaacgtggtactaccgcctttaatgtacgaggtgggcgagctgaacagaaacactataatgcaacgcagaaatccactctttctggcgtggatacctctcaagcgaatgtatcaggtcaagtgaatacagatttaaccaaggcaaaagctgtcacacgtgatgatacttacgcaagtacgcaatttagttttgaagtggcagatattgtggaattaggacagagagcgaaaaacaagctgtcagcaccaaacaatgacaccgatatggcgtcaggctccacattacgctcgcgttctactacagaagaagcagatgtaccaacaacaagatcgcgtgtaacggatgaggcggattctgtatccgtgaaaaatccgatttatgaaagtgcagatgctgttgtaccaacaccacgtagtagaaatgtggacagtaccgatcttgtggacaatccactgtatgctagtgccactacaaaagcaaacatccatgattatgaagaaattccagccgtttatagcaaagtcggtgataacaatgctgatcttgttcgtcataaaacggcaactagtgatgagcatctttatgcagagattaatgaaccaacatatagccgtgttggtgataaaaatgcagatatgagacgtcataacgcggcaggtacaacagactatgccgatgtcgtgcaagcacatacaagaaaggcagatgatccactaccagcattaccgaatcagggtaaagcaagaacggtaaacgacggttcagagcatatttatactgatattagcgacgtgggcactcaaactaaagctattgatagtacttatgcaacagtaggcatgccgaaagcgaatgccgttaacttgatagggcaaaatggcttaggcagcatttatcacagcccagacagtgcttataaaacatggcaattgcttgatcaatttgccaacaaaggcggagatgcggtcttcttacgccctgcaacagaaatgaaatgtgcaggtgcacctttaaaatatacctttatcgtgcgtgattatttgctcagacgccataccttagataaatcaagattattttataacgcacataataaaaccttatttagcgtgcctatcgttgatgcaaaagtcaaaatgctgtttgctgaaaaaaatatccaagtcaattacgatcgtagccttacagccattgatctgagtaaacgtattgcgacctttaatagcccagaaggagttgtagaagtcccttatgattttattaatgtggtacctccaatgcgagcacctgatgccgttcgtcaatcagcactcgcgtggcaagaaggaaaatgggctaacgatggttgggttgaagtagaaaaacataccttgcgtcaccgtcgttatgccaatgtgtttgctgtgggtgatgtggcaggggtcccaaaaggcaaaacggctgccagtgtcaaatggcaagttcctgttgcagtggcacatttactcgcagaattagagggcaaaccttgtgatgaaatttacaacggttatacatcttgtccattaattactcaattaggaaaggggatgctagtagaatttgattataacaaccacttaacaccttctttccccggtgtaatagcgccattagaagaactgtgggcaacatgggcaattaaaacattaggtttaaaacccacttatttaggtatgttacgtggattagcttaaggagcgttga

SEQ ID NO: 16 - protein, 2110 aa, Pasteurella multocida
MQPAQEHCQRINNIVNQENGLFHTLGNMMLEAERSVYNIGDIYASKKLTVHTHNLINDVRLSGNVSYKPIGSSRDYDISRVAVHGWHNNVYKLNLNLQEQDKTDIKVVKMGAIRSDGDFDFKGIKATSSESKPQLINHGLINVKGTFNAEADQVVNQMKAFNQNALASVFKNPAKITMYYQPLTRYIWTPLSGNASREFNNLESFLDALFGSTTILKSSFYSTENFSAYQLLSHIQHSPMYQKAMAQVFGAEWHSKSYDEMRNKWKSFKENPTDFIYYPSEKAKILAGKLEGKLTTLQNGEYAERGKFDESIQIGKHQLSLPSVELKAEFSDKERLEEDGVDLSSIAELLEMPNLFIDNSIQLEKKKLSPIEDLDEEPRKNLDIEESHSNSSDDVLSMNDDESDTDDSKWSMGNDEKEMPDDKLGISRDDRGNKPPRTDPTVDYLNPDEFFENGYLLNELLQELGEEPLLKEGEDHFKRSTNLVRLGERDRQNREKREKEGYFDLPGTLDMKLQELFEKRKQKHEAEQKARIEKALLQKSEQQEKRVEERKQEEKRQAQDKIAKQVEIAKEMQRVEEIRQREKQLAIQLQEEEKKQQEEKHLSEEKKQAEQKQKAEEKVAQERLDIEQQKAYEEMAKREAEASKNVLLKAIDEERPKVETDPLFRTKLKYINQDDYAGANYFFNKVGLNTKGHQKVNVLGDNYFDHQVITRSIEKKVDNHLNQKYNLSDVELVKQLMDNSTTQAQELDLKLGAALTKEQQANLTQDIVWYVKTKVKGKDVFVPKVYFASETLVEAQKLQGLGTGTIRVGEAKIKAKDVVNTGTLAGRKLNVEASNKIKNQGSILSTQETRLVGRKGIENVSRSFANDELGVTAQRSEIKTEGHLHLETDKDSTIDVQASDIKAKTSFVKTGDVNLKNTYNTKHAYREKFSPSALQVAELDVAGLKVPLLGVSSPSSYSEHTSEATSEGSIFEVGHLHLAVDRDVNQAGSKIKAKYTTGVVKGNFNTEAGKNIKHVEKEEYSSQLFASAHASGGGTSVRYDYNSQDGGNASVGVPTNHTGVGAEAGMSFTHTKDKETLLTHTNSELQVKHGKLHVLGYADIGGVDINTKLPEDAQSKAQKEIAASKPEKTEQSAQDVAQAQSNANKDKENKAPEIKELSEAEIADLMSEKSKAYFDDFAEQAKKAPENNRFELSAKEIKSSKQKDQYDHESERTTFKVGPEAEAHSAVADMVSHLVKEYRDAQNGTKQDGTVALQHASDVLNIVTGDLAGSSAKLSVERTHETKRTTETGDIVTKIGGNVTLSARSGSVNLKNVQSDEQANLTLRAKEDVNVLSGEKTRETTETVSRQKLSHGVNAGCSMMSGACTAGVSTSLEGNESYTSERETAQNNSFLKARNMKVEAGRDFNVVSSNIDADKLDLHVKGKTNVVSKQDTLQKVTHGVDYNLSAGVALSSATIATPTGNVGFGYTNETESKRTVNQQAGIKANKITGQTHDLNLEGGYLVSNDKDNQLKVTGDVTTKALHDQHDKDGGTFGLSVGISERGTTAFNVRGGRAEQKHYNATQKSTLSGVDTSQANVSGQVNTDLTKAKAVTRDDTYASTQFSFEVADIVELGQRAKNKLSAPNNDTDMASGSTLRSRSTTEEADVPTTRSRVTDEADSVSVKNPIYESADAVVPTPRSRNVDSTDLVDNPLYASATTKANIHDYEEIPAVYSKVGDNNADLVRHKTATSDEHLYAEINEPTYSRVGDKNADMRRHNAAGTTDYADVVQAHTRKADDPLPALPNQGKARTVNDGSEHIYTDISDVGTQTKAIDSTYATVGMPKANAVNLIGQNGLGSIYHSPDSAYKTWQLLDQFANKGGDAVFLRPATEMKCAGAPLKYTFIVRDYLLRRHTLDKSRLFYNAHNKTLFSVPIVDAKVKMLFAEKNIQVNYDRSLTAIDLSKRIATFNSPEGVVEVPYDFINVVPPMRAPDAVRQSALAWQEGKWANDGWVEVEKHTLRHRRYANVFAVGDVAGVPKGKTAASVKWQVPVAVAHLLAELEGKPCDEIYNGYTSCPLITQLGKGMLVEFDYNNHLTPSFPGVIAPLEELWATWAIKTLGLKPTYLGMLRGLA

SEQ ID NO: 17 - DNA, 3247 bp, Pasteurella multocida
  CDS (1479)..(3245): fhaB2
gtcgaccttgcgggtgaaaaggtatctctaaattttggcgatatcattcatgcttaccaaaaccagcccctatcaacaaaagttgtttttcaattagtgaaagatttgacggaagttttataccgttctggctacgtgacaagtgcaattggtttaaaaaattcaaaaatcagcaatggcgatcttgaatttattgtactgtggggaagaactcgcgatctgtttgtgaatggggagaaaccaacccgttttagagataaaacaatgttatcagtcctacccaatttaatcggaaatcgcttaagtattcacgacattgaccagttgatcgaaatcttaaatactacgaataaaaaagccacagtgaatgtggttgcaagtgaagaaaaaggcagctcaaatctaaatattgaaagacaatatgatgtttttccgcaagtgagtgtcggattcaataattcaggtgctggcaataatgccaatgggcgtaatcaagctacattgaatattgcttggagtgatctattaggcacgaatgatcgttggagtttctcgagtagttaccgtttatataaaaatcatcatgctaaccagcaacgcaattatactttgtcttacagtcagcctataggcttttctacagtagaaattaaagcatcggaatctacgtatgaaaaagaacttcgcggtataaatactcattcttctcatgggaaaacccaaagcttagctgtcaagctgatgcatgtgttattgcgtaataaggagagtattttatctacatataccgagttcgagtttaaaaaacggattagttatttttctgatattttgattgggaaatatcacaataataaagtgagcgtagggttatcttacatgactaattttgcttacgggaagctttacagcgacattgcttacgcgaatgggttgagatggtttggggcgaattattcagcatatgatgcaaatcgtgaaaaaaccttaaaattattgtcaggaagtattaattggcagcgtccaatatccctgtttgaacgtgcgatgaattatcaattacgtattggtgcccaatatggttttgatagtttgtattctgaaaatcaattttcaattggtgatgaatatacagtaagaggatttaaaggtggtgcggtttctggtgatagtggtgcgtatttatcacaaacactgacggttcctttttatccacaaaaagcatatttatctcaggtatccccttttattggatttgatatgggtaaagtacatattaaatcaaagcataaaacaaccactttagtcggttttgccctaggcttgaaaacgcaaataaagttattttcattatcattaacctatgcacaaccaatgaatggtgtgagtggtgttacgcaacatcgtcaaaaaccgatttattatttctcaggatcactttctttttaatctcttttaagtttaaggattaacttaatatgaacaaaaatcgttacaaactcatttttagtcaagtcaaaggttgtctcgttcctgtggcagaatgtattaactcagctattagcaatggttcatctgattcaacatccacatcagaacaagttgaagaggaacctttccttctagaacaatattcactttcctccgtgtctttattagtaaaaagcacgttcaatcctgtttcgtatgcaatgcaattgacttggaaacagctttctattttatttttaactgtgatttctgttcctgttttggctgagggaaaaggggatgaaagaaatcaattaacagtgattgataatagcgatcatattaaattagatgcatctaatcttgctggtaatgataaaacaaaaatctatcaagcagaaaataaagttctggttattgatattgctaaaccaaatgggaaagggatttcagataaccgttttgaaaaatttaatattccaaatagcgcggtgtttaataataatgggactgaagcgcaggcaagatcaacattaattggttacattccgcaaaatcaaaatttaaggggagggaaagaagctgatgttatattaaatcaagtgacaggtcctcaagaaagtaaaattgttggcgcgcttgaagtattaggtaaaaaagctgatatcgtcattgcaaaccaaaatggtattaccttaaatggtgtaagaacaataaattcagatcgttttgttgccactacgagtgagcttatagatccgaatcagatgatgttaaaggttacaaaaggaaatgtgatcattgatattgatggtttttcgacagatggattaaagtatttagatattattgctaaaaaaattgaacaaaagcaatcaattacatcaggggataattcagaagcaaaaacagatgtcactcttattgcgggttccagtgaatatgatttaagcaaacatgagctgaaaaaaacgagcggtgaaaatgtatctaatgatgttattgctatcacgggatctagtacaggcgcaatgcatggtaaaaatattaagttgattgtgacagataaaggtgcaggcgtaaaacatgatggaattattttgtctgaaaatgatattcagattgaaatgaatgaaggtgacttagaacttggcaatacgattcagcaaacagtggtaaaaaaagaccgaaatattcgagccaagaaaaaaattgaagtgaaaaacgctaatcgtgtttttgttggtagtcaaacgaaatcagatgaaatttcgttagaggcgaaacaagttaaaatcagaaaaaacgcagagattaggagtacgacacaagccaaaatcgtagcaaagggtgccctgtctattgagcaaaatgcgaagctcgtcgctaaaaagatagatgtggcaacagaaactctaactaatgctgggcgtatttatggtcgagaggttaagcttgacactaataatttgattaatgataaagaaatttatgctgaacggaaattgagtattttgacgaaaggaaaagatcttgaaattattcaagatagatatttgtctccactgatgcgcgtaaaaagtagtgtccgctttttaggctctccgtttttctcaatatctccgtcgatgctcgcaagccttagtgcacagtttaagcctggttttgtgaataagggactcattgaaagtgcggggagtgcagaattaacttttaaagaaaaaaccagttttttaacagagggcaataattttattagagctaaagatgcgttaac

SEQ ID NO: 18 - protein, 589 aa, Pasteurella multocida
MNKNRYKLIFSQVKGCLVPVAECINSAISNGSSDSTSTSEQVEEEPFLLEQYSLSSVSLLVKSTFNPVSYAMQLTWKQLSILFLTVISVPVLAEGKGDERNQLTVIDNSDHIKLDASNLAGNDKTKIYQAENKVLVIDIAKPNGKGISDNRFEKFNIPNSAVFNNNGTEAQARSTLIGYIPQNQNLRGGKEADVILNQVTGPQESKIVGALEVLGKKADIVIANQNGITLNGVRTINSDRFVATTSELIDPNQMMLKVTKGNVIIDIDGFSTDGLKYLDIIAKKIEQKQSITSGDNSEAKTDVTLIAGSSEYDLSKHELKKTSGENVSNDVIAITGSSTGAMHGKNIKLIVTDKGAGVKHDGIILSENDIQIEMNEGDLELGNTIQQTVVKKDRNIRAKKKIEVKNANRVFVGSQTKSDEISLEAKQVKIRKNAEIRSTTQAKIVAKGALSIEQNAKLVAKKIDVATETLTNAGRIYGREVKLDTNNLINDKEIYAERKLSILTKGKDLEIIQDRYLSPLMRVKSSVRFLGSPFFSISPSMLASLSAQFKPGFVNKGLIESAGSAELTFKEKTSFLTEGNNFIRAKDAL

SEQ ID NO: 19 - DNA, 3247 bp, Pasteurella multocida; identical to SEQ ID NO: 17
  CDS (1)..(1446): fhaC

SEQ ID NO: 20 - protein, 482 aa, Pasteurella multocida
VDLAGEKVSLNFGDIIHAYQNQPLSTKVVFQLVKDLTEVLYRSGYVTSAIGLKNSKISNGDLEFIVLWGRTRDLFVNGEKPTRFRDKTMLSVLPNLIGNRLSIHDIDQLIEILNTTNKKATVNVVASEEKGSSNLNIERQYDVFPQVSVGFNNSGAGNNANGRNQATLNIAWSDLLGTNDRWSFSSSYRLYKNHHANQQRNYTLSYSQPIGFSTVEIKASESTYEKELRGINTHSSHGKTQSLAVKLMHVLLRNKESILSTYTEFEFKKRISYFSDILIGKYHNNKVSVGLSYMTNFAYGKLYSDIAYANGLRWFGANYSAYDANREKTLKLLSGSINWQRPISLFERAMNYQLRIGAQYGFDSLYSENQFSIGDEYTVRGFKGGAVSGDSGAYLSQTLTVPFYPQKAYLSQVSPFIGFDMGKVHIKSKHKTTTLVGFALGLKTQIKLFSLSLTYAQPMNGVSGVTQHRQKPIYYFSGSLSF

SEQ ID NO: 21 - DNA, 1170 bp, Pasteurella multocida
  CDS (639)..(1022): greA
gtcaacaaacggcaaccacttcggcaaaaagcgattgcgcttgtgttctgctctaagctcaagcgttgggatcgcgcgaattgcgttgaccactggtgagatcggggtcacctgtaaaacgtacgataagatcgccatgcatttcattgttttttatttttccattggttaatagactggtttcaaattgaaattggtcacttagtacgagtttggcggttaaggcggtgagcactttttgtgtactggcgggtaacataaaggtactggcttggtgcgctacaattttttcattacgatttaagtttttagccacaaaacctaggctggtcccttcgggtaaatgagcgttgatttcagcaagatcaatctcagcataactgaaatgactgacgagtaaactacatataagtatcgttcgtttgaaaaggcgtaaaagcgtggcagtaaaaaaagaagatattttatacataattggctcgagcagttgctatttttttattgtcgaacaataatagtatttgaaccctcgagagtaaatccttttctcgttaaacacttatttttttattcaactacggcattgtttttacaatgttgtggttttgtttttatctaaaaaggaagaaaaaacgattatgaaacagattccaatgactatacgtggtgcggaacaattaagacaagaactcgattttttgaaaaacactcgtcgcccagaaattattaatgctatcgcagaagctcgtgaacatggcgatctaaaagaaaatgcagaataccatgctgcgcgtgaacagcaaggattttgtgaaggacgaatccaagaaattgaagggaaattagcgaatagtcaaattattgatgtcacaaagatcccaaataatggcaaagtgatttttggtgccacaattttgttactgaatattgacacggaagaagaagtctcgtaccaaattgtaggcgatgatgaagccaatattaaagcagggctaatttcagttaacgccacgcgattgaattagagaaagctaaatggattgcccaagatcttggcgtcaaacaaacgttaattgacacttccgtcattaaagcgattacgcaaaatgccttaatggacgaacaggcaagaattgagcaacatggcagtacaccgaatactttcgttga

SEQ ID NO: 22 - protein, 128 aa, Pasteurella multocida
MKQIPMTIRGAEQLRQELDFLKNTRRPEIINAIAEAREHGDLKENAEYHAAREQQGFCEGRIQEIEGKLANSQIIDVTKIPNNGKVIFGATILLLNIDTEEEVSYQIVGDDEANIKAGLISVNATRLN

SEQ ID NO: 23 - DNA, 4666 bp, Pasteurella multocida
  CDS (980)..(2440): guaB
aacacatgaacctcttccccaaaatacgcatccatatctcgccaatcttggcgaaatgcttcatcaattcctgcttgttcaaaatgttgtaaacgtgcaatcaactttttacctaattctgcgatcaatttattccgatcaatcgttggtaatacttcaatcagctctgcccaaggttgatcaatttgctgtgtttgttttgggaaagacaaattaatgccaaagccaatcacgagattatgttgattattctgacgattggcgatttcgaccaaaatccctgctaatttgcgcccatgtaatagcacatcatttggccattttaatccaatgttcaaagcacctgcttgctttagcgtttctgcgattgccatacccactactaaactcaagccttctaaattgaccttttggtcacatgcccaatacaaactcataatcacttgtccagcaaaaggagaaagccattgacgaccacgtcgtccacgtcccgcagtttgatattctgctaagcaaatagcgcctttttccaaatgtgcaatattgtcaagcaagaattgattggtcgagttaataatcggcttaatataaagtgggtaaggtgctaacgcttgcgtcaaataagattcatttaagcgacttaattgaggtatgagacgaaaatgttggacttgctgttctatttgtatcccttgttgtttcaatttttcgatattgtgtaagatatcttgttctgaataacctaaaagtgcagtcaattctgctaaagaaagttgttgatagctagcgagtaatgcaagtacgttttgcataaaaatccttatttatataaccaaagagaggcaacttattatagacaatgattttctcgaaaatcgataaaaaaatccattttcaaacagcaacgaaatctgtataatgcgaccgcaatattttttacccttttatttttcatatcaacctaagagagaatattgcaatgttacgagtaataaaagaagcattaaccttcgatgatgttttgcttgtcccagcacattctactgtgctcccaaataccgcagacctttccactcaactcaccaaaactatccgcctcaatatcccaatgttatccgccgccatggataccgtgacagaaactaaactggcaatctctcttgcacaagaaggtggcatcgggtttattcataaaaatatgtctattgagcgtcaagcggaacgtgtccgcaaagtgaaaaaatttgagagcggtattgtatccgatcctgtcaccgtttcaccaaccttatctttagcagaattaagtgaattagtgaagaaaaatggttttgcgagtttccctgttgttgatgatgaaaaaaatcttgtcggtatcattactggtcgtgatacacgctttgtcacggatttaaataaaacagtggcggactttatgacccctaaagctcgtcttgtcacggtgaaacgcaatgcaagtcgcgatgaaatttttggtctaatgcatacacaccgtgtagaaaaagtccttgttgtcagcgacgatttcaaattaaaaggcatgatcaccttaaaagactaccaaaaatccgagcaaaaaccacaagcctgtaaagatgaatttggtcgtttacgtgtcggtgctgcagtaggagcaggacctggtaatgaagaacgtattgatgcattagtgaaagcaggggtcgatgtgttattgattgactcatcacacggtcattcagaaggtgtgttacaacgtgtgcgtgaaactcgtgcgaaatacccagatttgccaattgttgcaggtaatgtggcaaccgctgaaggcgcaattgcgttggctgatgcaggggcaagtgcagtgaaagtggggattggtcctggttcaatttgtacaacacgtattgtcacaggcgtgggcgttccacaaattacagcgattgccgatgcggcagaagcactaaaagatcggggtattcctgtgattgcagatggcggtatccgtttctctggtgatatttcgaaagccattgcggcgggcgcctcttgtgttatggtgggttccatgtttgcaggtacagaagaagcaccaggtgaaatcgaactttatcaaggtcgtgcctttaaatcttatcgaggtatgggatcgttaggtgcgatgagcaaaggctcaagcgaccgctatttccagtccgataatgcagctgacaaattagtaccagaaggtattgaaggacgtattccatataaaggattcttaaaagaaattatccatcaacaaatgggtggattgcgttcttgtatgggcttaacgggttgtgcaaccattgatgaactccgtaccaaagcgcagtttgtgcgcattagtggtgcagggatccaagaaagccatgtgcatgatgtgactatcacaaaagaagcccctaattatcgtatgggttaaacattgcttaggtggggattatccccacctaagtttattttaaataacaacgttaatagagaagcttatttttatgtatggcattaaaattaaaaatgttattaaactttttctattaaagtttttaagaaataaatatcgatataaaatcaatattcaacatcatctcattagtattgaaggaaaatgcggtgagtttgatttaagccagctaaactatgtttatttggtgaaagatcctgagataagaaataatcgactgacactgtacttgaatgattttttcaaaattggggtaaattatcatggatttactcaaatgtatcagacactatcatccaagtatggttttgatgacgcaacgttttttgaatatctttgtaagaaagggcctttttctattcaaatttggcgtaaaaaacaaactcaaaattatgtgattcttgatgaagcctatactgactatacacaaggttttgaaattcaatctcctgaaaaaatatttattccttgggggactacttatgaagccttatttcagcagacacaatttaaagaaaaaggaatctcttatgactttatcttccctattcggatagggcgtttattactcaaggatgtgtggatcacaccaagtgtccgaaaagatgtaccgattttagcgttatacactgagtgctatcatgaatccgcgacagaaaaaagttatcaggaattaaccgccgcattacgtgagaaccaacagttaatcagatcatgtgttgaagaacgagccgatccgaaattatataagtctgttttacgccttaacgcgacagaatttgaattgcgttattatcgacatatacgagacgattttgataggggatacactaaattcagcattagagatacgacagactatttagattatgtgatcaacgagccttatgaaaatcaattagtgataacggattatttagtgattgaggcgcaaaatttaataaaaatggattataccgataattccattattaaacgccgaccaccaaaaataaaagaaaagtttcgtgatgcacaaagcctgatttggacagatgatctcaatcataaaatcggttttaccagtgatgaccgcgctatcgtctttgataaagcggacattgaatcctttactctggcaaatatagagacaacccgaagacataatcgcagttcactcagcatctgttttgtggataaaaataaggaagccatcactgtatttctagctgaacatcattttctgataccctatgtggataaaataaaaacactgacacaaaaagaggtgttgtttcttgaagaatatatagaggatgtttaaaaaaccgataacatcttgatgtcatcgcaaattcaaactccttttacacaatatatttaaactttaacccgatttaatatttacgtaaaaacaactaagagaacttaaatgaacaacattcacaaccataaaattttaattttggacttcggttcacaatatacccagttgattgcccgccgtgtacgtgaaattggcgtgtactgcgaactttgggcatgggatgtatccgaagccgatattcgtgagtttaatccaactgggattattctttctggtggtcctgaaagtaccactgaagaaaacagcccacgagctcccgaatacgtattcaacgccggtgtacccgtattagggatctgttatggtatgcaaaccatggcgatgcaactaggtggtttaactgaaacttctactcaccgagaatttggttatgcatcagtgaatctaaaagccgcggacgcgttatttgctcaattaaatgatgatgtcgcaagttcacagcccaaattagacgtttggatgagccatggcgataaagtgacgcgtttgccagatcatttccaagtcaccgcaatgacctcaacctgtccaatcgcagctatgtcggatgaacgtcgtcgtttttatggtgtccaattccacccagaagtgactcatacaaaaagcgggcttgaattattaacgaattttgtggtgaagatctgtggttgtgaacgtaactggacaccagaaaatatcattgaagatgccgttgctcgtcttaaagcacaagtgggcgatgatgaagtgattttaggcttatctggtggcgttaactgccgtataggcagcttagaaaaagtgtccgcgctcacgttaatccccgtaagcgttga

SEQ ID NO: 24 - protein, 487 aa, Pasteurella multocida
MLRVIKEALTFDDVLLVPAHSTVLPNTADLSTQLTKTIRLNIPMLSAAMDTVTETKLAISLAQEGGIGFIHKNMSIERQAERVRKVKKFESGIVSDPVTVSPTLSLAELSELVKKNGFASFPVVDDEKNLVGIITGRDTRFVTDLNKTVADFMTPKARLVTVKRNASRDEIFGLMHTHRVEKVLVVSDDFKLKGMITLKDYQKSEQKPQACKDEFGRLRVGAAVGAGPGNEERIDALVKAGVDVLLIDSSHGHSEGVLQRVRETRAKYPDLPIVAGNVATAEGAIALADAGASAVKVGIGPGSICTTRIVTGVGVPQITAIADAAEALKDRGIPVIADGGIRFSGDISKAIAAGASCVMVGSMFAGTEEAPGEIELYQGRAFKSYRGMGSLGAMSKGSSDRYFQSDNAADKLVPEGIEGRIPYKGFLKEIIHQQMGGLRSCMGLTGCATIDELRTKAQFVRISGAGIQESHVHDVTITKEAPNYRMG

SEQ ID NO: 25 - DNA, 2364 bp, Pasteurella multocida
  CDS (191)..(1828): Hi1501
gtcaacactcatcgcacagctgaggcatttcccgaaagctgatcatgatgatggacctgatgcgctagagatgctgtggaaaaatgcggtaagcagctctgccccgattgagttcatgacaattgacggcgatttagggcgtgatgaatttgatgacggcgatttatacagtatttggcggagataaaaaatggcgaagaaaaagaaaaaattacaacaagcgaaaaaagtacaagttggcttagatacacaaacaaatgaggcgcgtgtcacggagacaggaagaattatttctgatcacccaagcaataaaattacccccgcaaagttaaaagggattttagaagatgctgaaggtggtgatattaccgcgcaacatgagcttttcatggatattgaagaacgcgacagttgcatcggggcaaatattcaaacccgtaagcgtgcgattttaacccttgactggcgcattgcagagccacgtaatgccacaccgcaagaagaaaaactgcaagtcgaaattgacgagcttttctatcaattcccaatgctagaagatttaatggtggatatgatggatgcggtaggacatggtttttcggcgttagaaattgaatggaagcaagctgaaagtaaatggattccagttaattttatcgcacgtccgcagtcgtggtttaaactagacaaggatgataatttactgcttaaaacgccagataatcaagacggtgagccgttgagacaatatggctgggtagtgcatacccacaaatcaagaacagtacagcttgctcgtatgggtttatttagaacgctcgcatggctttatatgtttaaacactactcggtgcatgattttgccgaatttctagagctttatggtatgccgattcgtattggtaaatacccatttggggcaacgaatgacgaaaagcgcacattattgcgtgcacttgctcaaatcggacataacgcagcagggattatgccagaaggaatgaatgttgagttgcataatgtgacaaacactactggctcggctggaagcaacccgtttttgcaaatggtggactggtgtgaaaagtccgccgcacgtttgattctagggcaaacattaacaagcggtgcagatggtaaaacttcaactaatgcccttggacaagtgcataatgaagtcagacgtgacttgcttgtgtctgatgctaaacagattgcacaaactattacacaacagattattctgccatatcttcaaattaacattgatccgaatattttgccttctcgtgtgccgtatttcgagtttgacacgaaagaatatgctgatttaagtgtcctagcggatgctattcctaagcttgtgagcgtaggagtgcgcattcctgaaaattgggtgcgtgataaagcgggcattccagaaccgcaggaaaatgaaacgattttaagtgcggttcaacatgattttaaaacagatttaaacgatgttgaaaatccgaaaaaacagaccgcactttctgtacaaaatcacgtgacaggttgtcagtgtgatggctgtcgtggtgttgcattatctgcgaataataacagttctactgcgcagggcgtgctagatggtggacttgcgcaagcatttaatgagcctgattttaataaacaattaaatccaatggtaaagaaagctgttgcggtactcatggcatgtgactcttacgatgaggcggcagaaaaactcgctgaagcatacccagaaatttcaagtcacgaacacgaacagtatctctcaaatgcgctgtttttagctgatttacttggaggaactaatgtctaaaccgcttagttttctattcggacttgaaccaacgcaagccattgagtttttacataataaaaaattacttgcaacgaaagtgtttaaaaaatcactgcatgatagtgccatcgcaagagctacaacaatcgcgagattatctagtcttgagatgacgaatgatatttataaatcaatggaagttgccaaaaaagagggtaagagctttacacaatggaaaaaagacttggtaagtgagtttgagaaaaaaggctgggtattcgggcatgataaatctatcagtcgcggtatcgacggaaaactgttggctgatccgaaaacaggcgaatattttggtacaccgcgtcggctgaatacaatttatcgtacaaacgtgcaagccgcatattctgcggcgcgctatcagcgcatgatggataatattgatcatcgcccctattggcaatattccgctgtcagcgatgagcgtacacgaccctctcatcttgcactaaacggtcgaatttatcgctatgatgacccgttttggtcga

SEQ ID NO: 26 - protein, 546 aa, Pasteurella multocida
MAKKKKKLQQAKKVQVGLDTQTNEARVTETGRIISDHPSNKITPAKLKGILEDAEGGDITAQHELFMDIEERDSCIGANIQTRKRAILTLDWRIAEPRNATPQEEKLQVEIDELFYQFPMLEDLMVDMMDAVGHGFSALEIEWKQAESKWIPVNFIARPQSWFKLDKDDNLLLKTPDNQDGEPLRQYGWVVHTHKSRTVQLARMGLFRTLAWLYMFKHYSVHDFAEFLELYGMPIRIGKYPFGATNDEKRTLLRALAQIGHNAAGIMPEGMNVELHNVTNTTGSAGSNPFLQMVDWCEKSAARLILGQTLTSGADGKTSTNALGQVHNEVRRDLLVSDAKQIAQTITQQIILPYLQINIDPNILPSRVPYFEFDTKEYADLSVLADAIPKLVSVGVRIPENWVRDKAGIPEPQENETILSAVQHDFKTDLNDVENPKKQTALSVQNHVTGCQCDGCRGVALSANNNSSTAQGVLDGGLAQAFNEPDFNKQLNPMVKKAVAVLMACDSYDEAAEKLAEAYPEISSHEHEQYLSNALFLADLLGGTNV

SEQ ID NO: 27 - DNA, 1353 bp, Pasteurella multocida
  CDS (2)..(1351): hmbR
  misc_feature (375)..(375): n is a, c, g, or t
  misc_feature (399)..(399): n is a, c, g, or t
  misc_feature (423)..(423): n is a, c, g, or t
  misc_feature (453)..(453): n is a, c, g, or t
gtcaacgaaagtcggttacgatattaataacactcatcgttttacactgtttttagaagatcgccgtgaaaagaagcttaccgaagaaaaaacattagggcttagtgatgcagtgcgttttgctaatgatcaaaccccttatctccgttatggtattgaatatcgatataacggcttgtcttggttggaaacggtaaagctttttttggcaaagcagaaaatcgaacaacgttctgctctccaagagtttgatattaataataggaataaattggattcgactatgtcgtttgtatatttacaaagacagaatatagctcggggagaattttcaacgagtcctttatattgggggccgagtcgccatcgtttatntgcgaaattcgaatttcgtgatangtttttagaaaatatgaataagcnttttacgtttcggccgtggcaaatcaatanattcagacaacaaggtcgaaataactatacagaagtgtttcccgttaaatcccgagagttttctttttctcttatggacgacattaagattggcgaattgctacatctcggattgggcggtcggtgggatcactataactataagccattattaaattctcagcataatatcaacaggacacagagattaccttatccaaaaacatcatccaaattttcgtatcaattgagtttagagtatcaattacatccatcacatcaaattgcataccgtttaagtaccggttttagggttccccgtgttgaagatctttattttgaagaccgaggaaaaagttcttcacaatttcttcctaaccccgatctacaaccggaaactgcactgaatcatgaaataagttaccgtttccaaaatcaatatgcccatttcagcgtcgggcttttccgtacacgttatcataactttattcaagaacgtgagatgacctgtgataaaattccatatgagtataataggacttatggatattgcacgcataatacttatgtaatgtttgttaatgaacctgaagccgtgattaaaggggttgaagtaagcggtgctttaaatgggtcggcattcggactttccgacggtttaactttccgtctcaaagggagctacagcaaaggtcaaaatcatgacggcgatccgttaaaatctattcaaccatggacagtggtaaccggtattgattacgaaactgaagggtggagcgtgagtttgagcgggcgttatagtgcggctaaaaaagccaaagatgcgatagaaacggaatacacacatgataaaaaggttgtcaaacaatggccgcatttaagtccatcctactttgttgttgattttacggggcaagttga

SEQ ID NO: 28 - protein, 450 aa, Pasteurella multocida
  misc_feature (125)..(125): The 'Xaa' at location 125 stands for Tyr, Cys, Ser, or Phe.
  misc_feature (133)..(133): The 'Xaa' at location 133 stands for Lys, Arg, Thr, or Met.
  misc_feature (141)..(141): The 'Xaa' at location 141 stands for His, Arg, Pro, or Leu.
  misc_feature (151)..(151): The 'Xaa' at location 151 stands for Lys, Arg, Thr, or Ile.
STKVGYDINNTHRFTLFLEDRREKKLTEEKTLGLSDAVRFANDQTPYLRYGIEYRYNGLSWLETVKLFLAKQKIEQRSALQEFDINNRNKLDSTMSFVYLQRQNIARGEFSTSPLYWGPSRHRLXAKFEFRDXFLENMNKXFTFRPWQINXFRQQGRNNYTEVFPVKSREFSFSLMDDIKIGELLHLGLGGRWDHYNYKPLLNSQHNINRTQRLPYPKTSSKFSYQLSLEYQLHPSHQIAYRLSTGFRVPRVEDLYFEDRGKSSSQFLPNPDLQPETALNHEISYRFQNQYAHFSVGLFRTRYHNFIQEREMTCDKIPYEYNRTYGYCTHNTYVMFVNEPEAVIKGVEVSGALNGSAFGLSDGLTFRLKGSYSKGQNHDGDPLKSIQPWTVVTGIDYETEGWSVSLSGRYSAAKKAKDAIETEYTHDKKVVKQWPHLSPSYFVVDFTGQV

SEQ ID NO: 29 - DNA, 4936 bp, Pasteurella multocida
  CDS (1078)..(2769): hxuC
gtcaacaacaaagcgcacaggcattacttcatgccacacacatcatacagaaagtacgtaccgatttaacgcaaattaatgccgtcaacattcatcttttcctatcataaagcgtttcatcatggctagcattctagcaaaaattagttgaggaaaatagcggtcttgttttgcttaaaaaacaacccaccccgtagggcacggctgtttctttttgagaaattacgcttcttcatcttgatcttttttcaagatctcatcttcattgagttttaaaagacgggcaatcgcattgcggtaggagatttcaaggctttctcgactagtagcaatgacaccttgatcgattaagaaaccgtcattgacatcataaacccaaccatgtaatgagagttttttcccatttttccacgcggatttaatgattgacgagcgacctaagttataaacttgctctgcgacgttaattttcgtcagcatatcagcccgtttttcaggcggtaaattgccaagtaaatgactatgcttataccaaatatcgcgtaagtggagtaaccagttattaattaaacctaaatcttgatccgccattgcggctttaattccaccacagtttgtatgtccacaaataataatgtgttcaatatttaagacctcaacggcatattgcacaacagataaacagtttaaatcggtgtgaatgacttgatttgcaacattacgatgcacaaacagctcacccggtcctaaatttgttaatttttctgcaggaacacggctatccgagcaaccaatccaaagatagctcggggtttgatgatcagccaattctttaaagtaagaggagttttcctctttcatccgtaacgcccagctataattattggcaaaaagttgttcaatttttttcattagagtgattcctataccgcaaaaataagggggctagtatagcttagaaatagacagtgggtaaagaaaggcaaaaaattgtataggataacttgttttttattgccatttatttagaattagaatctttaataataaaaataattatcattaaggttaatagttatggataaaaatttaatgaagggatgtgtattcttatcaatagtcggttgcggtatccaaatagggctagcatcaaatccaaatcctccagatgtggatgagttattacctattattgtgaatgctgatgaagataataaattaccaggtcgttctgtattaaaacagaaaaatatcgatcaacaacaagcagataatgccgctgacttaataaatattttacctggggtaaatatggcgggaggatttcgccctggtggtcaaacattaaatattaatggaatgggtgatgctgaagatgttagagttcaactagacggcgcaacaaaaagtttcgaaaaatatcaacaaggctctatttttattgaacctgagttattaagaaaggtgacagtagacaaaggaaattattctcctcaatatggcaatggtggctttgctggtactgtaaaatttgaaacaaaagatgcaactgattttttgaaagaaaatcagaaaataggtggattatttaaatatggaaataatagcaataataaccaaaaaacttatagtacagccctagttttacagaatgaacaaaaaaatattgatttgttattatttggttctgtaagaaatgcaagcaattatacaagacctgataaaagtaaaattcttttttcaaaaaacaatcaaaaaagtggattaataaaagtaaattggcaaattactcctgaacatttattaactttatccagtgtttatggcattcataaagggtgggaaccttgggcagcaaaaagagatgtgatgtcgagaccaacagaaacagaaataaaacactatgggattgatgttgcgtggaaacgtaaacttgtttatcgagatcaaaaagatgaaagttattcattgaaatatcgctatttacctgaaaataataagtggattaatttgtctgttcagctgagttatagtaaaacagagcagaatgatactcgccatgagaaagtcacttcttcattcctaggtacattaggaaataaaagttggataacttattcagatcttacttttgatataagtaacacaagtactctaaatattgggcgtgctgagcatgaactactatttggtttacagtggttaaaaaataaaagaaatacccttatgtatcataaagggggagtcaagaaggcagactataattatggctattttcagccttattatatgccttctggacgccagtatacacaagcattttatttacaagatcaaataaaatggcagaatttcctctttacaggagggataagatatgaccatatcaataatatagggcagaaaaatttagcgccacgatataatgatatctctgcaggacatgattatagccagaaaaattataatggttggtcttattatttaggtcttaagtatgatgtaaatcattatttaagtttatttacgaattttagtaaaacttggcgagcccctgttattgatgaacagtatgagacacaatatagtcaagcttctgtatctgcgacttctttaaatttagaaaaagaaatgattaatcaaaccagagtgggtggaattattactctcaatcatctatttcaggaaaatgatgcttttcaatttagaactacttatttttacaatcgcggcaagaatgaaatcttcaaaacgagaggggttaaccgttagagttggttgaaatgactgaaaaattagacctatacgttactgttaaaggtggcggtatttctggtcaagcgggtgcaatccgtcacggtatcactcgtgcattaatcgaatatgatgagagtttacgctctgtattacgcgcagctggtttcgttactcgcgatgcacgtcaagttgaacgtaaaaaagtgggtttacgcaaagcgcgtcgtcgtccacaattctcaaaacgttaatttttcttttacgttttatattcagattgcaagcccaaaaggcttgcaatttttttatctcaataaaatttacgataatctttggaaatcagtgggcgatttgtggtagaataaacgcccattttttatataaaatcatgccagaatcaggcaaagtttaataaattttaattcattttagagctgtcggaggaatagatgacaagcgctgcaaataaacgttcaataatgacacttttttcagataaaacagatatttattgccaccaagtaaggattgttttggctgaaaagggtgttgcttatgaaacggaagttgtagatcctcaagtcgtatcagaagatttaatggaattaaatccgtatggcacgttgccgacattagttgatcgtgatttagtgttatttaattcacgtattattatggaatatcttgatgagcgtttccctcatccacctttgatgcctgtttatccagtggcacgtgggaaaagccgtttattaatgttacgtattgagcaagattggtacccagtattagcaaaagctgaaaaaggcacggacgcagaacgtgctgtcgcattaaaacaattaagagaagagattttagcgattgcgcctattttcacgcagatgccttattttatgagcgaagagtttagtttagtagattgttatatcgccccattattatggcgtatgcaagaactgggtgtggatttcagtggggcgggtagcaaagcaattaaagcttacatggcacgtgtttttgaacgcgattcatttatgcaatctttaggcgtgtcggctccgaaaaacttaatggatgagaaataatcagtatgctacataaatcatcaccaaagcgtccttacttgttaagagcgtattatgattggttagtggataatgatttcaccccttatttagtggtggacgcgacttatgttggtgtgaaagtccctgtggaatatgtcaaagatgggcaaattgtcctcaatttatctgcgaatgcgacaggtaatctggtactaagcaatgaaagtattcagtttagcgcgcgttttcgtggtatttcacaagatatttttattcctatgggggctgcgttagccatttatgctcgtgaaaatggtgatggtgtactgtttgaacctgaagcgatttatgatgagctcgcaacacaaaatattggtattgagcagccactgagctttgttgaggctgtcgataaaccaaaaaccagtgagaatactcaaaaaagcacaaacaaagacaaaacgacggaaaaaaaagcgacttctcatttaagaattattaaataaaagaggttttctttcttcataaaaaaacacgcttttacgcgtgtttttttgttgcggacagtttattgtgccattttttttgcggcttttaagaagccttgcgcactcgtgtagatgtcacttttattctgtgccgctaaaatcatatccgacatttcacgaaaggccccttgtccacctttcaggcttagtacgtgatcagcgtgcattttgatataagcggcgcatcttgtactgcaaaggcaacaccacagcggcaaaagcaggcagatcaacgctgtcatcaccaatataagccgtttcttgcgcacagacattggcttgttgtatcaattcaagacaggcgctttctttttccaatttgccgaggaaaaagtgttggatgcctagatctgcaatacgtttgcgtagaatcggggaatctcgccccgagagtaccgcgacttgaatgccagattccattaacattctgatccccaagccatcacgaacatgaaaggttttgaaagcttcaccatgggcatcgtaatgcaaagagccgtcggtcagtacaccgtcgatatctgtaatcacaaatttaatttttttgagtttttccgttga

SEQ ID NO: 30 - protein, 564 aa, Pasteurella multocida
MDKNLMKGCVFLSIVGCGIQIGLASNPNPPDVDELLPIIVNADEDNKLPGRSVLKQKNIDQQQADNAADLINILPGVNMAGGFRPGGQTLNINGMGDAEDVRVQLDGATKSFEKYQQGSIFIEPELLRKVTVDKGNYSPQYGNGGFAGTVKFETKDATDFLKENQKIGGLFKYGNNSNNNQKTYSTALVLQNEQKNIDLLLFGSVRNASNYTRPDKSKILFSKNNQKSGLIKVNWQITPEHLLTLSSVYGIHKGWEPWAAKRDVMSRPTETEIKHYGIDVAWKRKLVYRDQKDESYSLKYRYLPENNKWINLSVQLSYSKTEQNDTRHEKVTSSFLGTLGNKSWITYSDLTFDISNTSTLNIGRAEHELLFGLQWLKNKRNTLMYHKGGVKKADYNYGYFQPYYMPSGRQYTQAFYLQDQIKWQNFLFTGGIRYDHINNIGQKNLAPRYNDISAGHDYSQKNYNGWSYYLGLKYDVNHYLSLFTNFSKTWRAPVIDEQYETQYSQASVSATSLNLEKEMINQTRVGGIITLNHLFQENDAFQFRTTYFYNRGKNEIFKTRGVNR

SEQ ID NO: 31 - DNA, 9814 bp, Pasteurella multocida
  CDS (4762)..(7662): iroA
gtcgacctgcagcagacaatgtccactgtgtaatagtccaacgactgttataaaaatcttccgctgctttttctaatgtttgtacacggtgtttttcaaattcttccaaattcttggttggttggactaaaagttgttcagccgccgctttaaaattggcgacaaaatccgattgtttgattaaaccataggattttgcttggatttgtgcgccggctgcttcacccaatttatcgaaaaattcaggcgtataagtcacgtttgggatcgtaggcgcgatgatctgattaacaccagcctgttgtaatgctccccattgctgtgccatcgtttgtgccatggttttaatactggctaacacgtaggcttgtttctcttcaggtgttgtcttcgttactgctgttgctaatactgtcgccaaatcattaccacctgcccatagaatatgtaaagcttcttttttgactggcgcatgtaaatactcgttgatctgcttttctagtgctaaatgaggttgttctgctgttctagtattatgtgcaccaacaatcaccccaccgctgtacgcgtagttcaaaccaccttgtgtagaaggtattaattttttcccaaatgcttgagctaaatattcatcataaaggtgatgatagtttccatcagcctttaaataagaggctttcttattccaacctgtttgccccatatcacttaaactatcaccaaacacgacaacatcttgtgccagagcagccgaacttagtgaacaaaataatgcgaatgaaagtgtattaattttcacaataatgtccttcaattattcatcgtcagtcaaaaatttgcgtcatcatacgttgattataggaagatacctagccagaccactactggtatgaacagaagtcaatgtttaatcacataaaaaagcctctgtgctttcacacagaggcttttatgtccattcacctactcaaattacatcgcttgagtaaaggtacgcgtaatcacgtcttgttgttgttctttggttaacgagttaaagcgtactgcataacccgaaacacgaatggttaattgtggatatttctccggattttccattgcatctaacaacatttcacggttcatgacgttcacgtttaagtgttgtccgccttcaatcgttgcttcatggtggaagtaaccgtccattagacctgcaaggttacgtttttgtgcttcgtaatctttacctaaggcatttggtacgattgagaaggtataagaaataccatctttcgcataagcaaatggcaatttcgcaacagaagttaacgatgctactgcacctttttggtcacgaccgtgcattgggttcgcacccggtccaaatggtgcaccagaacgacgaccatctggggtgttacctgttttcttaccataaaccacgttagatgtaatagtaagtacagattgtgtcggtgtcgcattacgataagtacccaatttttggattttcttcataaagcgttcaactaaatcacaagcgatttcatcaacacggttatcgttgttaccgaattgtggatattcgccttcaatttcaaagtcgattgccacatcttttgcaataccaaccacttcacccgctttatttttgatttcgatatcaccacgaactggtttcactttcgcatatttaatggcagataaagagtccgctgcgacagaaagccctgcgataccacaagccatagtacggaatacatcacgatcatgaagtgccattagtgcggcttcatacgcgtatttatcgtgcataaagtgaatgatgttcaatgcagtaacatattgtttcgctaaccaatccataaagctgtctaagcgcgtcatgacatcatcataatctaagtattcgctggtaattggatcggttttcggtcctacttggtcacctgatttctcatccacaccgccattgattgcgtataacaaggttttcgctaagttggcacgtgcaccgaagaattgcatcattttacccacgatcattggcgatacacagcatgcaatcgcatagtcatcgttttggaagtcaggacgcattaagtcatcgttttcatactgaacagaagacgtatcgatagacacttttgccgcataacgtttgaaaccttctggtaatttttcagaccaaagaatcgttaagtttggctctggtgacggtcccatcgtataaagggtgtgtaagatacggaagctgtttttggttactaaagtacgaccatctaagcccatacccgctaaggtttccgttgcccacattgggtcgcccgagaataattgatcgtactctggggtacgtaagaaacgcaccatacgtaatttcatgactaagtggtcaattaattcttgtgcttcttgttctgtaattttgcctgcttttaaatcacgctcaatataaatatctaagaaagtcgatacacgaccaaatgacatggcagcaccgttttgtgatttcactgcagcggtacgactttgcacagttatcggaagataattgaaatcataaccagcaacaaatgtcagccgttctatttcttctgaagaatatcggcgattgcgttctggcggaatggctggttttttcacattcttgagatgattttctttcaagtatttccattctgtgattgctgtcgtaataatgtgcgaaagagtattccattctctaagcacacttgccgcactaacttgtgaaagtcgttcatcacgccactgcacaaagtgatgttcttgtaaatcgattaatctcacgttagaaatcggcatatttagcaagcgaagtaaacgcaacttttcagcacgatagccctttttatttatgctcacttctttgatatatttatcgacaagttgtgcaaaagtgatgtcgggaatatcagtgaatacaccgtttatgattttttgttctatgtctaacgcccacgcttgcgcatcagctttagtccgaaatgttgctgatttatagacaccttttttgcgaatttgaactcgccaacctgatttttgtttgttaaaagtcgccacgcctaactaccattaattttgcacaattcgttgtgcaattttgtgcaattttatttcttaaatgatgtttagcggatcataaatgaagaaaaaacagaagtaaaacactatataaaaaaacagtatattttttgttgaagtgcttaatgtagtttgtaacttattgatttttaaatattaaagataaagaaaaagccgacaaaagtcggctttctttttttatgctgtttatcaatggtgcctagggccggactcgaaccggcacacccgaaggcggttgattttgaatcaactgcgtctaccaatttcgccacccaggctaatattgataaagagcatcaaattaggtctgtattataccttttcattgataggttacaagcaaaaaatgattttagatattcaattgtctttattttcatcagtgtggctgttctctcttactttattcaggtgcagtgaagtaaccttataaaaataaaggttttttgtttaaattttaaataacttttttgtaaaaagatcgcagtttcttttgaaaaaaagaccgattacaaatataattaaaaactattatcaatattgataataatgggattttaaccatgacatttataaggataaagtcaagatgatgctaaaagcacaaattgcagattatattacacaaaatccactggcaattactttggatatggcttcgcactttggcaaacctgaaggtgaaattttatgtgctttacctgatgagtttgttcgagtgtttcctgcggaacgtgcggaggaagtgcttgctgagatcagtagttgggggattttcacgaccattattgaaaaagaaggatcgatttttgaaattaaagaccgttttccgaccgggatggttgggcgtggttattataatttgaatatgaaagatgaagaaggcacgcttcatggtcaccttaaattagataacatcagcaaaattgcctttgtgagtttaccgtttcgcggtaaagaaagttataacatcgcatttattgcgaataatgggcaaactatttttaaagtttatttggggcgcgatgctgagcgtcaattatttccagaacaagttcaaaaatttaaagcatttatttagaaggttaaaaaagtaatgacaacaaatcgtcaagaagtattacaaaatcgtttaggtccagaaattcaagagttaaaggcacaatgtaaaacagtcatgctcgctactgtcggtgaagatggtaatcccaatgtgagttatgcgccatttgcaattaataatggggaataccaagtctttatttctactattgcacgtcatgcacgtaatctacaagaagtaccaaaagtttctttaatgttgatcgaagatgaaagttaaagtcgtcagatttttgctcgtcgtcgtttatcttttgatgcggttgcgcgtgttgtcgagagagaaagtgaagaatggcattctggtgttgaggcactcaaagcaagacatggtgcattaatggatgaattgtctcggatgaaagattttcatttgtttagttttaagccctcacaagggttatttgtaaaaggttttggtcaagctttccaagtgagtaatgatgatttagtgagctttgttcacttggttgaaggacaccaagaataaattttgtcaactttttagggtatttacttgaggttaggaaaatgcgtacaacaacaataaaattttctgcaattacattggcattattgagttattgtgggaccattttggcggatagtcatcaagaggcgactgaacttgatacgattaccgtttcttctcaacaagatgagatgaatattaaagagaaaaaaatcggtgaaactgtgaaaacggcgagtcaattgaaacgccagcaagtacaggatagtcgtgatcttgtgcgctatgaaaccggtgtgactgtggtagaagctggacgttttggttcgagcggttatgccattcgtggtgtggatgagaaccgagtagcaattacagtagatggcttacatcaagcagaaaccctttcttctcaaggctttaaagaattattcgaaggttacggcaattttaacaatacccgaaatagtgtggaaattgagacgttgaaagtcgctaaaatcgcgaaaggtgctgattctgtaaaagtgggtagtggttctttgggaggcgctgtactttttgaaacaaaagatgccagagatttcctgactgaaaaagattggcatatcggctataaagcgggctactcaacggcagataatcagggattaaatgcagtgactcttgcaggtcgctatcaaatgtttgatgcattgattatgcattctaagcgacatggacatgaattagaaaattatgactataaaaatggcagagatattcaagggaaagaaagagagaaagcggatccttatacgattacgaaagaaagtacattagtgaaattctctttttcgccaacagaaaatcatcgttttacagtcgcttctgatacttatcttcagcattcccgcggacatgatctttcatataatcttgttgcaacaacacatattcagttagatgagaaagaatctcgtcatgcaaatgatttgacaaaacgtaaaaatgtttcctttacttatgaaaattatactgttacgccattttgggatacgctcaagttaagctattcacaacaaagaattacaacaagagcaagaacagaagattattgtgatggaaatgagttatgtgattcttataaaaatccattaggtctccaatttaaagatggtcagattcttgatcctgcagggaataaaattaaactacaggggtctggattgagcactcagattgtagatgaaaatggaaaaccatttcctacaacaacaggtactaataatgctgcttttagtaataatttacgactcaggcctacaggtttttggttagattgctcggtttttgactgtaataaaccattcactgtttataatattagtaatggaacatatcaagcaagagaggttctactgtctgaagagataactgtggatggtaaattatacaaaacagctaaggaagaaggagggcttccaaattatttgattttacctaattctaaaggttatcttccttatgattataaagaaagggatcttaatacgaatacaaaacaaattaatttagatttaactaaaacatttttaactttcaacatcgaaaataatctgtcatatggtggagtttattctcggatagagaaagaaatgattaataaagctggttatgaggggagaaatcctacttggtgggctgatagaattttagggcaaagtagttactgtggttataatgcattgaagtgtccgaaacatgagccattaacgtcatttttaattccagttgaagcaacgacacagtcattatattttgcaaatattcttaaggtacataatatgattagcatagatttaggatatcgttatgatcatattaaatataaccctgaatacactccaggagtaactccaaaaattccagatgatatggtaaaaggtttgtttattcctatgccaaaagagccacagctaaaggattttgattataactatgctaaatttggtgaggcctataaaaaatggaaagaatatctgccaaaaaatgcggaagaaaatattgcttacattgctcaagataagacatttaaaaaacattcttattctcttggtgcaactttcgatcctctgaattttttacgagtacaagtaaaatattcaaaagggtttagagccccgacttcggatgaactttattttacctttaagcatccagattttacgattttaccgaaccccgtgttgaaaccagaggaagcaaaaaatcaagagattgcattaacagtgcacgataattggggatttgttagcacaagtgttttccaaacaaagtatcgtcattttattgatttagcgtatttaggttcaagaaatttatcgaattccgtgggagggcaggcacaagcaagagatttccaagtttatcaaaatgtcaatgtcgataatgccaaagttaaaggacttgaaattaatgcacgtttgaatttgggatatttttggcatgtgttggatggatttaatacgagctataaattcacttaccaacgtggtcgtttggatggcgatcgtccaatgaatgcgattcagcctaaagcttctgtttttggtttgggctacgatcataaagaaaataaatttggcgctgatttatatattacacgtgtgagtgagaaaaaagcgaaagacacttataatatgttctataaagaacagggatataaagatagtgctgttcgttggagaagtgatgactatacgctagttgatgcggttggttatattaaaccgattaagaatttaacgttacagtttggcgtttataatttgacagaccgtaaatacttgacatgggaatctgctcgttcgattaaaccatttggtacaagtaatttaattaatcaaaaaacaggcgcaggaattaatcgtttttactcaccaggtcgtaactttaaactcagtgccgaaatcaccttctaatcctaagcctgcgtatgcaggctttctttttagggaaagtgcggtggatttgacaaagatttattgcttttctgtaaatcaatgctaaaattcacactcctttgtcgtagctggattagagatcggctagcgatgtatttttaacttaacttttaggagttatcaaatgtctctaagtacagaaaaaaaagcagcaattgttgctgaatttggtcgtgatgcaaaagataccggttcttcagaagtgcaaatcgcattattaactgcacaaatcaaccacttacaatctcactttgcaacgcacaaaaaagaccaccacggtcgtcgtggtttattgcgtatggtttctcgtcgtcgtaaacttttagattacttaaaacgtactaatcttgagctttacacttcaactatcgctcgtttaggtttacgtcgctaatttgtattaggatttattccaaacaaaaaacccttgataattttatcaagggttttcttttttctgcatactaggcatgtttaaattatcgcaaaacacaccgcacatttcgtggaaaagtgcggtcatttttttaatttattttacttctttaaacatgatctcacttgggattactgaaccttgccagtaaagctcagtagcgactttttcagctaattgcataaacgattgggcaatgtcgctttcaggtgcggcgacaacggttgggatacctttgtctaaatcttcacgtaagcgaatatgtaatgcctgttgtcctaaaactttgacattatatttttgtgcaatgcgctcagcaccgcctgttccgaaaatcgtttcttgatgaccacaattgctacaaatatgcatcgacatattttcgataatgcctaaaacgggtacagaaacacgctcaaacatcgccacacctttaatcgcatccagtaaagcaatatcttgtggtgttgtcaccacgaccgcccccgtcactggaatttgttgagaaagggtcagctggatatcccctgtacccggtggcatatcaatgactaaataatctaaatcaggccataaggtttcttgcaaaagctgacttaaggcactgcttgccattggaccgcgccaaatcgtagcattgtccggttccattaagaaaccaatggaattggcaaaaatatgatgtgcttgaattggggtaatgtgctggttatctggcgaagttgggcgttgatcagcaacccctaacatgtgtggaatagatggaccataaatatcggcatctaaaattccaacacgagcaccttgtctttgtaaggcaagagcaagattgacggaaatagtagattttcctacaccacctttacccgatgtcacggcaataatattttttaccccttttacggctgggtggctattagcgcgttttaatgtcgcgatttgataatttaattgccatttgatgtctttgcattctgctaatgtgagaagttctgtggagagagcgctcttgagttgttcgaatgcagtattccaagcaaacggcatgctgatttcaatacgtaacgtctcaccgcctttttcaatttttttgatagcatttaggctgacgagatctttttgtaagctaggatgttgaaattgttgaaatgtgttttggatagcttgtttttgactgtccgttaaactgtcagaaaataaaattcccattgattttatcccgttatttttggtggctaattaaagccctagttaatcactcaactatatttaaccacgaagctgtagaactgttaagcagaaatgtggaaaagcgcggttaaagtagaaaaaatactgcgaataaggtaacataagcgccaattttttgatgaaaaataggaatgataacatggcaaattcggcacgcgatattttggtcacttgcgccttaccttatgcaaatggtgcaattcatttagggcatttattagaacatattcaagcagatatttgggtgcgttccaacgtatgcgtgggcataaagtgcattttatttgtgcagatgatgcccatggcacaccaatcatgttaaatgcgataaattaggtattacaccaaagcattaattgctcctcgaaagcagaacatgtggcggatttgaaggcttaatattagctatgataatatcat

SEQ ID NO: 32 - protein, 967 aa, Pasteurella multocida
MRTTTIKFSAITLALLSYCGTILADSHQEATELDTITVSSQQDEMNIKEKKIGETVKTASQLKRQQVQDSRDLVRYETGVTVVEAGRFGSSGYAIRGVDENRVAITVDGLHQAETLSSQGFKELFEGYGNFNNTRNSVEIETLKVAKIAKGADSVKVGSGSLGGAVLFETKDARDFLTEKDWHIGYKAGYSTADNQGLNAVTLAGRYQMFDALIMHSKRHGHELENYDYKNGRDIQGKEREKADPYTITKESTLVKFSFSPTENHRFTVASDTYLQHSRGHDLSYNLVATTHIQLDEKESRHANDLTKRKNVSFTYENYTVTPFWDTLKLSYSQQRITTRARTEDYCDGNELCDSYKNPLGLQFKDGQILDPAGNKIKLQGSGLSTQIVDENGKPFPTTTGTNNAAFSNNLRLRPTGFWLDCSVFDCNKPFTVYNISNGTYQAREVLLSEEITVDGKLYKTAKEEGGLPNYLILPNSKGYLPYDYKERDLNTNTKQINLDLTKTFLTFNIENNLSYGGVYSRIEKEMINKAGYEGRNPTWWADRILGQSSYCGYNALKCPKHEPLTSFLIPVEATTQSLYFANILKVHNMISIDLGYRYDHIKYNPEYTPGVTPKIPDDMVKGLFIPMPKEPQLKDFDYNYAKFGEAYKKWKEYLPKNAEENIAYIAQDKTFKKHSYSLGATFDPLNFLRVQVKYSKGFRAPTSDELYFTFKHPDFTILPNPVLKPEEAKNQEIALTVHDNWGFVSTSVFQTKYRHFIDLAYLGSRNLSNSVGGQAQARDFQVYQNVNVDNAKVKGLEINARLNLGYFWHVLDGFNTSYKFTYQRGRLDGDRPMNAIQPKASVFGLGYDHKENKFGADLYITRVSEKKAKDTYNMFYKEQGYKDSAVRWRSDDYTLVDAVGYIKPIKNLTLQFGVYNLTDRKYLTWESARSIKPFGTSNLINQKTGAGINRFYSPGRNFKLSAEITF

SEQ ID NO: 33 - DNA, 2990 bp, Pasteurella multocida
  CDS (1106)..(1564): kdtB
gtcaacccctttggctttgagttgtgctaataaagcatcgtcaaaatgcaagccggcagttggtgccgcaaccgcgccagggactttgttataaacggtttgataacgttctttatccgcttcttcgtcagggcgatcaatataagggggcaatggcatatgcccaatttgctgtaacacgtctaaaagtgcggtctgtttttgcgcgatttctaattcaaataaggtatcatggcgcgcaaccatgatcattttgacaccatgatgttcacctaacttatcttcgcctaaccacagttctgccccttctttcggtgcttttgaggagcgcacatgggctaaaaagcgtgtgtcggataaaatccgctcgaccaacacttccaccttaccgccactggctttacgtccaaacatccttgcaggaatcacgcgcgtgttattaaaaattaataagtcgccttcatgaatttgatcaaggatatcagcaaaagtgcggtgggtaatctcaccattttcgccgttaagttgtaataagcgactagcggtgcgatccggttttgggtaacgagcaatcagctcatcgggtaaatcaaaataaaagtcagaaacacgcataaatagggttataaaaagttatctaaaaaatcgtgggcgtaagtctagtgtgaattccgctcttgcacaaggaaaaatccagattttgttgtttagtatcgaattgagatgattttggacaaaaaaaaagccctttcaagaaagacgaaagggcgaaaatatatttggagtcatactttttagggtatgtgtcggattatacacacaaaaataacaaatgcaacatttttttaacaatcatatgtaagcgtattgtgtgagaacgagcgtaaaaatgaacgcattctaaaggatgatttatttagcctattaaaaaaacacatgagatgagagtttgcgagagcggtaataaaagtgcggtgggttttagaaaagttttgaataggatcacaaattaaacaaagtttgtgaaataccaagtagtagtttttaagtatatgatgaatcatatgctaaagtttaaacccgttaaataaccaagaggtggaagatgacagaagaaaataaaggaaagagatattttttatggttcatattgtttatcctttcaatctatttatttattaccatacaagaaagacgaggttattgttttgacaaacgtgcatatattcatgagctttatactgagcaagagttaattgatcgggggattgaatatgtggtatccaccatgccgtcaggtgttattaaaccagatggcacaataaaagaagtaaagcgttacacgagtgtcgaggagtttaaacagatgaacccagcttgttgtacattaaccacctttattgatgaaggaggcgatggctatccagatgatgatggatatggttatgtcagaattgaatatttaagacattatgttgagaatctaaaaccttatcatagagtgatttatcttgaatatacgccctgtggagagttaagggaagaggcggctttttcaaaaaattaagagtgaggtgaagaaatggcattaccaacagcaacaataatgaggaatttatctttatctaaaaatcaattcactctgaaagggatggaatgcgtagattccctatttcaagcatgcagtaatatggatcatgggtactgaggtggaagatggcagaagaaaataaaggaaagagatattttttatggttcatattgtttatcctttcaatctatttatttattaccatacaagaaagacgaggttattgttttgacaaatgggaatatatccataacctttataccgagcaagagttgatcgatagaggggttgaatatgtggtatccaccatgccgtcaggtgtttttgaaccagatggcacaacaaccgaaataaaacgttatgctagtgttgaggagtttaaacagatgaaccctgattgttgtaaattaacaagatttattaatgaaggaatagatggctatccagatgatgatggatatggttatataagaattgaatatttaagacattatgttgggaattttaaacctgatcatagagtgctttatctcgaatatacgccttgtggagaattaagggaagaggtttctttttaaaaaataaataatagtgaggtgaagaaatggcattaccaacagcaacagaaatcacaaatgcatatttatataaaaataaattaactcctaaagcggaggaaagagtagattcaatacaaattcttgaaaaaggagatgaacatttcgaagtaaattttaattgatcaaagtactctattgattgaaggaaaaacagtggaattaatggcaggtatggcagtttctgcggaaattaaaacaggtaaacgcagtgtattagattacttatttagcccattaaaaaccacaaaataatattaaggagaataatatgtcgtataataaatatactgttgctttgattacgttctcaacagggatctgtattccggcaatatgctacgctctaaattcgctgggatacagatcctgtttgagactatgtagaaaagactaaactttgtgtggttaactgggcttcggtaaaattctggaaacaaatgggcttaacccgcgtgatcttatcccgtgagctttcgcttgatgaaattgccgaaattcgtcagcaagtgccagaaatggaaattgaagtgttcgtgcatggggcattatgcatggcgtattctggacgttgtttattatcaggctatattaataaacgtgatccaaatcaaggcacctgtaccaatgcgtgccgttgggaatacagtgtaaccgaagccaaagaagatgagatcggcaacattgtgaatgtgggtgaagaaattccagtgaaaaatgtagcaccgacacttggcgaaggcgacaccaccagtaaagtatttttattagcagaaagtcga

SEQ ID NO: 34 - protein, 153 aa, Pasteurella multocida
MTEENKGKRYFLWFILFILSIYLFITIQERRGYCFDKRAYIHELYTEQELIDRGIEYVVSTMPSGVIKPDGTIKEVKRYTSVEEFKQMNPACCTLTTFIDEGGDGYPDDDGYGYVRIEYLRHYVENLKPYHRVIYLEYTPCGELREEAAFSKN

SEQ ID NO: 35 - DNA, 1683 bp, Pasteurella multocida
  CDS (325)..(1230): lgtC
  misc_feature (981)..(981): n is a, c, g, or t
  misc_feature (1000)..(1000): n is a, c, g, or t
  misc_feature (1129)..(1129): n is a, c, g, or t
  misc_feature (1134)..(1134): n is a, c, g, or t
  misc_feature (1144)..(1144): n is a, c, g, or t
  misc_feature (1423)..(1423): n is a, c, g, or t
  misc_feature (1665)..(1665): n is a, c, g, or t
  misc_feature (1667)..(1667): n is a, c, g, or t
atatcaaagtctcatggcaagaaaattagaaaagagcgatcaattattatttgcaagatttgggtattattcataggctaggtgaaagatatatttttccatgatattaaaacgattcaggcagaactggctagcttatcacttttagataattgtattattaaaagaagctgtatgattgttattctatcattagtggataataaatattctttattttttgagagataaaaacaattcatatttcaatagaaaacagaaaataaagattatcaaaagaattatccgtccttataaatatgagtctgtattgtgagatgatatatgaatattttatttgtttctgatgatgtttatgctaaacatctggtggttgcgattaaaagcattataaatcataatgaaaaaggtatttcattttatatttttgatttgggtataaaggatgaaaataagagaaatattaatgatattgtttcttcttatggaagtgaagtcaactttattgctgtgaatgagaaagaatttgagagttttcctgttcaaattagttatatttctttagcaacatatgcaaggctaaaagcggcagagtatttgccggataatttaaataaaattatttatttagatgttgatgttttggtttttaactcattagaaatgttatggaatgttgatgttaataattttcttaccgcagcctgttatgattctttcatcgaaaatgaaaagtctgagcataaaaaatcgatttcaatgtcagataaggaatattattttaatgcaggagtaatgctatttaatttagatgaatggcggaagatggatgtattctcaagagctttagacctgttagctatgtatcctaatcaaatgatttatcaggatcaagatatattgaatatcctttttaggaataaagtctgttatttagattgcagatttaatttcatgccaaatcaacttgaaagaataaancaataccataaaggaaaantgagcaacttacattctttagaaaaaacaacgatgcctgtcgttatttcacattattgtggtccagaaaaagcgtggcatgcggattgtaaacattttaatgtatatttctatcagaaaatattagcanaaatntcgagaggcncggataaagaacgcgtattatctataaaaacttatctcaaggccttgattagaaggattagatataaattcaaatatcaagtctattaactattgaatttttgcaaatgagataagagtatagtgctgatttcttcaaagcgaaaaggaggaaatagcttgttctaatttattacaataatggttgtattcatcttgattttgaaggaaagagagtgttttttgtataaaagcattttcgtcacctaaatttactaatcctccaaattctcctcctcgnagaatttctttcggaccggtagggcagtccatggatattacaggtgtaccgcaagccatgctttctaggataactgtcggtaacccctctttcaaagaggtgtgtaaaaatagcttagcattttttattaatggatacggattatctttatttcctaaaagaaaacaatcttcttgtagattgagtgattctatttgtttctctaatttttctcgacactcaccatcccaaacaatatatancntttcttggatacctcc

SEQ ID NO: 36 - protein, 302 aa, Pasteurella multocida
  misc_feature (219)..(219): The 'Xaa' at location 219 stands for Lys, or Asn.
  misc_feature (226)..(226): The 'Xaa' at location 226 stands for Met, Val, or Leu.
  misc_feature (269)..(269): The 'Xaa' at location 269 stands for Lys, Glu, or Gln.
  misc_feature (270)..(270): The 'Xaa' at location 270 stands for Ile, or Met.
  misc_feature (274)..(274): The 'Xaa' at location 274 stands for Thr, Ala, Pro, or Ser.
MNILFVSDDVYAKHLVVAIKSIINHNEKGISFYIFDLGIKDENKRNINDIVSSYGSEVNFIAVNEKEFESFPVQISYISLATYARLKAAEYLPDNLNKIIYLDVDVLVFNSLEMLWNVDVNNFLTAACYDSFIENEKSEHKKSISMSDKEYYFNAGVMLFNLDEWRKMDVFSRALDLLAMYPNQMIYQDQDILNILFRNKVCYLDCRFNFMPNQLERIXQYHKGKXSNLHSLEKTTMPVVISHYCGPEKAWHADCKHFNVYFYQKILAXXSRGXDKERVLSIKTYLKALIRRIRYKFKYQVY

SEQ ID NO: 37 - DNA, 2029 bp, Pasteurella multocida
  CDS (2)..(499): mglB
  misc_feature (98)..(98): n is a, c, g, or t
  misc_feature (296)..(296): n is a, c, g, or t
  misc_feature (302)..(302): n is a, c, g, or t
  misc_feature (928)..(928): n is a, c, g, or t
  misc_feature (1007)..(1007): n is a, c, g, or t
  misc_feature (1740)..(1740): n is a, c, g, or t
  misc_feature (1808)..(1808): n is a, c, g, or t
  misc_feature (1816)..(1816): n is a, c, g, or t
  misc_feature (1820)..(1820): n is a, c, g, or t
cttaaataaagccggtaaaattcaatacgttttattaaaaggtaaccaaggacacccagatgcagaagctcgtacaaaattcgtcattaaagaattanataataaaggcattcaagatgagcaattattcatcgacacggggatgtgggatgccgctttagcgaaagataaaatggatgcatggttatctagctctaaagcaaatcaaattgaagtgatcatcgctaacaacgatggtatggcgatgggggcattggaagccacgaaagcacatggtaaaaaattaccaatcttcngtgtanatgcgttaccagaagtcctccaattaatcaaaaaaggtgaaattgcaggtacggtgttaaatgacggtgtgaaccaaggtaaagccgttgttcaattaagtaataatcttgcaaaaggaaaacctgccactgaaggcacaaaatggcagttaaaacgatcgtgtcctacgtatcccttatgttggtgtggatgcggataacttaaacgagttcctaaaataataaactataacaaaacaagamgttgtaattctcggggaggtataccctccccctttttatgtgaggttggatatgacaactcaaattccaaatcaagacagtgaaatactgctcacaatgaccaacgtctgtaaatcctttcccggtgttaaagcgttagacaatgcaaacctaactgtgcgctcgcattctgtccatgccttaatgggcgaaaatggggcgggcaaatcgaccttattaaaatgcttatttggtatttacagtaaagatgaaggtgacatccttttcttaggcaagccagtcaactttaaaacgtcgaaagaagccttagagaacgggattttcatggtgcaccaagaacttaacttggttaaacaatgtactgtaatggataatcctttggntaggacgttatccattaaaagcaggctttgtcgatcacggcaaaatgtatcgtgataccaaagcagatttttgaagaantagatatcgatatcgatccaaaagaaaaagtggccaaattgtcagtgtcacaaatgcaaatgatcgagatcgcaaaggccttttcatacaatgccaaaatcgtaatcatggacgaaccgacttcttcgctttcagaaaaagaagttgaacacctatttaaaattatcgcgaagctaaaacaacgtggctgtggcattatttatatttcgcacaaaatggacgaaatcttcaaaatttgtgacgaaattacgattttacgcgatggtaaatggatcaatacggtcgctgttaaaggcaccacaatggatcagattgtatccatgatggttgggcgtgaactcacgcaacgtttcccaccaaaaaccaataccccaaaagaaaccatcttaacggtggaaaatctgaccgcacttaatcagccatctattcaagatgttagttttgaattacgcaaaggcgaagtgctcggcattgcgggactggttggggcaaaacggtaccgatattgtggaaacgatcttcggggtgcgtgaacgtaaatctggtgtgattaaactacacgataaggaaatgaaaaaccggaatgcgttcgaagccattaacaatggttttgccttggtcacggaagaacgtcgctctacagggatttatgcgaatctcagtattgagtttaactcattaatttctaacatgaagaaatcctatatcagcaagttaggtttattgagtaacncaaaaatgaaaagcgacacgcaatggggtcattgattccatgaatgtgaaaacgccatcacaaaaccnatattggntcantatctggggtggtaaccaacaaaaagtggtcattggtcgttggttattaacccaccctgaaatcttgatgttagacgaaccaacacgtggtatcgacattggtgcgaaatatgaaatttatcagctgattatggagttagccaaaaaagataaaggtatcatcatgatttcatctaaaggccagagttattaggggtactgaccgaatt

SEQ ID NO: 38 - protein, 166 aa, Pasteurella multocida
  misc_feature (33)..(33): The 'Xaa' at location 33 stands for Asn, Asp, His, or Tyr.
  misc_feature (99)..(99): The 'Xaa' at location 99 stands for Ser, Gly, Arg, or Cys.
  misc_feature (101)..(101): The 'Xaa' at location 101 stands for Asn, Asp, His, or Tyr.
LNKAGKIQYVLLKGNQGHPDAEARTKFVIKELXNKGIQDEQLFIDTGMWDAALAKDKMDAWLSSSKANQIEVIIANNDGMAMGALEATKAHGKKLPIFXVXALPEVLQLIKKGEIAGTVLNDGVNQGKAVVQLSNNLAKGKPATEGTKWQLKRSCPTYPLCWCGCG

SEQ ID NO: 39 - DNA, 2628 bp, Pasteurella multocida
  CDS (326)..(766): mioC
  misc_feature (1839)..(1839): n is a, c, g, or t
gtcaactagagtaaaatagacacacttaattacattgtagaggaatccttttatgtctttagaaattttagatcagttagaagaaaaaattaaacaagcggttgaaactatccaattacttcaattggaaattgatgaattaaaagaaaaaaataaccaatctcaacaagcaaatgacgcattacgcagtgaaaatgaacaactaaagagtgagcaccaaaactggcaagaacgtttacgctcattattaggcaaaattgataacgtataattcacttcttattaaggcttagtttttctaagccttattttttaggagaaattaatgaaaacaaaaatttgtattatcactggcagtacgcttggtggtgcagaatatgttgcagaacatattgctgaaatattagaacaacaagattatcctgtacgtttagaacatggaccaaattttgaagaagtgatcgatgaaaaatgttggcttgttgtcacctctacccatggtgcaggtgaattaccggataatattaaacctctgtttgaaaaattagcatttcacccaaaacagttagctgacttacgctttgcggtgatcgggttaggtaattcggattatgataccttctgtcacgcagtggatcatgtggaacaattactgctaagcaaagatgctttacaactgtgtgaatcgctaagaatggatatgctaaccattactgatcctgaacacacggccgaacaatggctcccacaatttctcagtcaattataatatttattccctatacaatggcatatgtaaatcaaatatgccatttttcatctcgatcaagcataatatttaaccaatcaaatcaatattttctctgtggataactaagatcaaaactgtataaaagctgtttttattccctgaataagattgaatgttttttattctgtggataactaaagaagttattcacagttttttctggtgccaaattgagatcttaacaacttaaaaaatgatctaagttattcatttaaaaaaagaaaaggatcttaatcacagcactataggatcctaataatcataataataagatctctttatataaaaagatcctatctttattaactcacgatctttttcacgatcatcgtacagtcttgatcaaaaatgtttctttcatggatccataaatttcagtagaatagccaaccagcaaaaaggatcaaaagatccataaaatccgagataaattaacaaggttactatgttttatactgaaaattatgatgttattgtgatcggtggtggacacgcaggtactgaagctgcacttgcaccggcacgcatgggactcaagaccctattattaacccataatgttgatacactagggcaaatgtcttgtaatcctgcgattggtgggattggtaaaggccatttagtccgagaaattgatgcgatgggcggtttaatggcaactgctgcggaccaagcaggaatccaatttcgtaccttaaacagcagcaaaggaccggcggtacgtgctacacgtgcgcaagctgaccgcgttttatatcgccaagcagtacgtattgcattagaaaatcaagaaaatttagatatttttcaacaagaagtgaccgatattattttagatcaggatcgtgtctgcggtgttgttactaaaatgggtttaaaatttcacgcaaaagcagtgattttaacagccggtactttcctttctggtaagatccacattggtttagaaaattatacaggtggacgcgcgggtgatcctgcttcagtgatgttagccgatcgtttaagagaactgaatttacgtgtanatcgtttaaaaacgggtacaccgccccgtattgatgcacgtactattgatttctcaatactggctaaacaacatggcgatgaaaaattacctgtcttttccttcatgggatctgttgatcaacacccacgtcaaattccatgttttattacccatacaaatgaacaaacgcatgaagtgatccgtaataacttacatcgcagcccaatgtatgctgggatcattgaagggatcggtccacgttattgcccttctattgaagataaagtaatgcgtttttctgagcgtaattctcatcaaatctaccttgaacctgaagggttgacaaacaaaacaaagaaattgcggatttacaaaaacaagtgcaagcactgcaagcagatttaagcgaaatggcaaagaaaaaccgcaatcaagcgttgattgcaggtggtattggcggtggcattgttgcagtcggtattgagctcattcgcttgcaatttgggggctaactgatggcatttgatgaaaaaacacgtgcgctggttcgtcgctactatgtatttgagtttttatcgcttgagcaatcagcaagtaaagctaaagtctcatttaacaccgcgcgacgctggaagaaagaggcggcaagcaagggcgatgactgggataaagtgcgtgatgtacaagtaatggcgggcaatgagctgactgatatcacaaaaggattgttatcgggctttattattcaatatcgcgcaaccatggatgagattcaaaactcggatttaaaagcacaagataaagtcga

SEQ ID NO: 40 - protein, 147 aa, Pasteurella multocida
MKTKICIITGSTLGGAEYVAEHIAEILEQQDYPVRLEHGPNFEEVIDEKCWLVVTSTHGAGELPDNIKPLFEKLAFHPKQLADLRFAVIGLGNSDYDTFCHAVDHVEQLLLSKDALQLCESLRMDMLTITDPEHTAEQWLPQFLSQL

SEQ ID NO: 41 - DNA, 5191 bp, Pasteurella multocida
  CDS (3203)..(4255): mreB
ctgcagtaccaaccacccaaatgttgtgcttctgctgtaattcacgcaaagtgcgcgcgaggttggttacacggattaatggcacgacttcagcggcaccacaagctactttacgtgcgatagcggttaattgggcagatttatcttttggtactatcacagcacacacgcccgctgcatccgcagtacgcaaacaagcacctaagttatgtggatcagtcacaccatctaacactaatagcaacggattggactgattttgtaaaagcgtatctaaatctgcttcattcaattctttcgctggctgaacacgtgccatgatgccttggtgtacttcgccctctgcttttttatcaagggtttggcgattaacaaattggatagtaatacccaaccgatgaagttcattgagcaaaggttgtaaacgtttatcgtcgcgccctttgagtgcataaacttcaattaaacgctctggcgcgttgtttaaaaaggcacttactgcatgaatgccataaatattttcactcatctactttctctttttagctgatttcttactggcttttttcgtggttgttgatggtttaacaacgcttgtttttcttaccgcacttttactggtgcttggtttacgtttatggcgttgtttttcgagactttcagcgtagcgtgcatttttcttgagcttgtctttggctgttttgccttctcgtaatggtttacgctcactcgacactaaagaaaaatccacttggcgttgttcaaggctaactgcttccacacggatttttaccttatcgccaatgcggtagatcataccactattttcaccgattaaacgttgtcgagcgagatcaaattggtagtagtcgttatctaaggtagaaatgtggactaagccatcaataaagaggtcatctaagcggacaaataagccaaaacctgtcacagatgaaatcacacctgtaaattcttcgcctacatgatcttgcatatattcgcattttagccagtctgcaacatcacgagtggcatcatcggcccgtcgttctgtcatggagcagtggtcgcctaatacatccatgtcatcaagtgtatagtgataccctcccgtatcagtggttctccgtttcgagccttttagtttggctaacaagtatttaatcccacgatgcaaagtcaaatcaggataacggcgaattggcgaagtaaaatgcgcatattcttcgagtgcaagcccaaagtgcccaatattgtcaggatgataaacggcttgacttaacgaacgtaatacatggtttgcaataactcatgatctggacgttcgcgaatttgctccaataatttagcgtagtctgcggtacttggtttactgccaccttcaaggcttaaaccacattcactgaggaattggcggaagcccgtcactttttcttcgcttggacccgcatgaatacggaaaagggctggctcttgatgtttttccataaagtttgccgccgcaatattggcgaggatcatacattcttcaatgattttatgcgcatcattacgaataacaggctcaatccgttcgattcgccccatttcattaaacacaaacttactttcaatggtttcaaagtcaatggcgccacgttgatgacgggcttccactaaggcttggtacattacatggagttcttttaaatggggaaccagtgcttgataacgagtacaaagttcttcatcgtcctctaaaatacgagcaactttggtataggttaagcgagcatgagagttcatgaccgcttcataaaattcatagcctgtgattttaccttttgctgaaacattcagctcacagaccatacataagcgatcgacttgtgggtttaatgaacaaagtccattggagaggatttccggtagcataggaacaacgcgatttgggaaatataccgagtttccacgcgcatgtgcttcggtatcaagggcagtacgtaaacgaacatagtagctgacatcggcaatggcaacccacagtttccaaccgcctccacgttttttctggcaaaaaaccgcatcgtcaaaatcgcgagcatcttcaccatcaatggtgactaacggaagatggcgtaaatcaatacgtcctgatttggcttcttccggtacttcttcactcagtttagaaacttgtttgaggaccgcgtctggaaaaacatggggaatatcatgattacggatagcaatttccacctccatcccttttgccatattttcaccgagaatttcgctaatcattccaacaggttggctaaatgttgcggtacgtggttttaattcaactacaaccacttgtcccatacgagcgccttggcggtgttcattcggaattaaaatgtcgcgattaattcgactatcgtcaggtactacataaccaataccatcttctaagaaaaaacgaccaacaatctgttttttacgctgttgtaagacgcggacaatccgcacttcttggcgaccacgacggtcaaaaccgctaggttgggcgaggacatagtcaccgtgcattactcgctgcatttggctgttgggtataaaccaatcgctgtctttaccttcgacttgtaaaaaaccataaccatcacgatgacctaatacggtcccttttaataaatccagtttttccggtaaagcgtagcgtttacgtttagtgaaaaccaattgtccgtcattttccatcgctcttaagcgacggcgcatggcttcttgttgttcttcattttgaatagcaaatgtggtcagtaattcttcttttgagataggtgcattatgttgacgaattgtatcaagaataaattcgcgacttgggatcgggttctcatattttgcgagttcttcttgatagtttggatcttgcaaatgtggattgtttttgatttttgccataatgactccctttgagaatggaaatacgcattcgtttaatgacctcaagtttgacactctgatttgttgaaagcaagtaaaaaacctgttcgtgactgaaacaatctgtactcgcgggatttgtcgtgcatgaaagcgtaaagacaaagcaaatttcgacaatttacagaaaattctctgttataaaggtacattttttgatacatttagcacaatttttcaatactcaaatcagagtgtccattatttaatttagttcagcggaattcttatgttatttaaaaaaattcgaggcttattttcaaatgatctgtccatcgatcttggcacagcgaataccttaatttatgtcaaaggacaagggattgttttagatgaaccttctgttgtggcgattcgccaagaacgttcaggtgcattaaaaagcattgctgcggttggtcgtgatgccaaattaatgttaggccgtacaccgaaaagcattgcagcgattcgtcctatgaaagatggggtgatcgcagatttctttgtgacagaaaaaatgttgcaatattttattaaacaagtgcacagcagcaattttatgcgtccaagtccacgtgtcttagtttgtgtacctgcgggagctacgcaagtcgaacgacgtgcaatcaaagaatctgccattggtgctggggcacgcgaggtgtacttgattgaggaaccgatggcggcagcgattggtgctaaattacctgtttcgactgccacaggttcgatggtgatcgatatcggtggtggtacgacggaagttgcggtgatttctttaaatggcattgtgtattcctcttcagtccgcattggtggtgatcgttttgatgaggcgattatttcttatgtacgcaagacgttcggttcaattattggggaaccgacagcagagcgtatcaaacaagagattggtagtgcgtttattcaagaaggcgatgaagtccgtgaaattgaagtgcatggtcataacttagcagaaggtgcgccgcgttctttcaaactcacctcacgtgatgtgttagaagctattcaagccccgttaaatggcattgttgcggcagtgcgcacggccttggaagagtgtcaaccagaacatgctgcggatatttttgaacgtggcatggtcttaactggtggcggtgcccttattcgtaatattgatgttttactgtcaaaagaaaccggtgtgccggttatcatcgccgatgatcctttaacctgtgttgcccgtggtggtggcgaggcattagagatgatcgatatgcacggtggtgatatttttagtgacgatatctaatatgatttaaaagtgcggtgatattagaccgcacttttacttctcttttattgctgacaaggctagcctaattcgtatatgaaacctatttttggaaaagcacctcctttaggtcttcgcttaattctggcgattttagcatccattgcattgattgtttcggacggtcaatccaatgcgatgattaaagcacgcagtattatggaaaccgcagtaggcgggctgtattatcttgccaatacaccgagaacggtattggatggggtttcagataatttggttgataccaataaattgcaaattgaaaaccgagttttgcgtgatcaactgcgtgaaaaaaatgcagatttattgttgttagatcaactcaaagtagaaaatcaacgcctgcgcttattgcttaattcccctctacgtacagatgagtataaaaaaattgctgaagttttaacggcagaaactgatgtgtatcgtaagcaagtcgtgattaaccaaggacaacgtgacggtgcttatgtcgggcagccgattattgatgaaaagggtattgttgggcaacttatctccgttggtgaaaatacgagtcgcgttcttctattgacagatgtgactcattctattccagtacaagtactacgtaatgatgtccgtttgattgctagtggaacaggacggaatgatgaactgagtttagatcatgtgccgcgttcggtcgatattgtcaaaggggatttattagtcacttctggattaggtgggcgttttttagaaggttatcctgttgccattgtggaatccgtatcacgtgatgggcaaaattattttgctactgtaacagcaaagccattagcttcgattgaacgtttacgctatgttttgcttttatggccgacgaatgaagagatgcgcaaagtccagtctatttcacctgca

SEQ ID NO: 42 - protein, 351 aa, Pasteurella multocida
MLFKKIRGLFSNDLSIDLGTANTLIYVKGQGIVLDEPSVVAIRQERSGALKSIAAVGRDAKLMLGRTPKSIAAIRPMKDGVIADFFVTEKMLQYFIKQVHSSNFMRPSPRVLVCVPAGATQVERRAIKESAIGAGAREVYLIEEPMAAAIGAKLPVSTATGSMVIDIGGGTTEVAVISLNGIVYSSSVRIGGDRFDEAIISYVRKTFGSIIGEPTAERIKQEIGSAFIQEGDEVREIEVHGHNLAEGAPRSFKLTSRDVLEAIQAPLNGIVAAVRTALEECQPEHAADIFERGMVLTGGGALIRNIDVLLSKETGVPVIIADDPLTCVARGGGEALEMIDMHGGDIFSDDI

SEQ ID NO: 43 - DNA, 2172 bp, Pasteurella multocida
  CDS (1)..(1464): pnp
acccgcgttgggattgggtggcacctgaacccaaataccgcgttaattgaaaaagtgaaagcgattgcagaagcgcgtttaggcgaagcataccgtatcactgaaaacaagcacgttatgaacaaaattgatgcgattaaagctgatgtgattgcacaaatcacagctgaagtagcagaaggcgaagacatcagtgaagggaaaattgtcgatattttcaccgcacttgaaagccaaatcgtacgtagccgtatcattgctggtgaaccacgtattgatggtcgtacagtggatactgttcgtgcattagatatttgtactggtgttttaccacgtacacacggttctgcgattttcacccgtggtgaaacacaggcgttagctgtcgcgacattaggtacagaacgtgatgcacaaattattgatgaattaacaggtgagcgttcagatcacttcttattccactacaacttcccgccatattctgtgggtgaaaccggtatgattggttcaccaaaacgtcgtgaaattggtcatggtcgtttagcgaaacgcggtgtagctgcagtgatgccaacacttgccgagttcccgtatgtggtacgtgttgtctctgaaatcacagaatcaaatggttcttcttctatggcatcggtttgtggtgcgtctttagcattaatggatgcgggtgtaccaattaaagcggcggttgcaggtattgcaatgggcttagtcaaagaagacgaaaaatttgtggtgctttcagacatcttaggtgatgaagatcacttaggtgacatggacttcaaagtcgcgggtacacgtacgggtgtgacggcattacaaatggatatcaaaatcgaaggtatcacagcagaaatcatgcaaattgcgttaaaccaagcgaaaagcgcacgtttacacattttaggtgtgatggagcaagcgatcccagcgccacgtgcggatatttctgattttgcaccgcgtatttacactatgaaaattgatccgaagaaaatcaaagatgtgatcggtaaaggtggtgcaaccattcgtgccttaacagaagaaacaggtacctcaattgatatcgatgatgatggtacggtgaagattgctgcggttgatggcaattcagcaaaagaggtgatggcgcgtattgaagatattactgcagaagttgaagcgggtgcagtgtataaaggtaaagttactcgtttagctgattttggtgccttcgtttctatcgtaggtaacaaagaaggcttagtgcatatttctcaaatcgcggaagagcgtgttgagaaagtgagtgattatcttgcagtggggcaagaagtgactgttaaagtggttgagattgatcgtcaaggtcgtattcgtttaaccatgaaagaagttgcaccaaagcaagaacacgttgattctgttgtcgcagacgttgccgcagaagaaaacgcataagcaataaacaccaacgcccttcgtgataaagggcgttggtgtgcatgttgataagtacaatttgtgctttaaggcgaagcgaaatgaagcaatttcatccgtggttaaagtgcctgctaattttcccattttgggtatgttgtttaacagcttgtgttaatcatgaacaagtttttctttcaaaagagaaattaatgttagcagagcaacatccgaatgatcatcttgagcatgaggtgatggttgcgcaaattagcgaattgttacttgttaaagggttaaaaaaagaagaacgtgcgattttacattttgagcgaggcgtgctgtacgatagcttaggattgtgggcattggcgcgttatgattttgaccaaacattagcgttgtatccaaagttggcagcagcgtttaattatttaggtttatatttattgttagaggaagattacagcgcatctctagatatctttaatgtgttgtttgaacttgatcctcaatatgagtatgcattcctaaatagagggctaaatttttattacgtcggacgttatgaattagctcagcgggattttcttcaattttatcaagccgataaatcagatccataccgcactttatggctttatttaaatgaattaaagcataatcctcaggatgcttctaaaaatcttgctcaacgagcaatggggctttctgatgaatatt

SEQ ID NO: 44 - protein, 488 aa, Pasteurella multocida
TRVGIGWHLNPNTALIEKVKAIAEARLGEAYRITENKHVMNKIDAIKADVIAQITAEVAEGEDISEGKIVDIFTALESQIVRSRIIAGEPRIDGRTVDTVRALDICTGVLPRTHGSAIFTRGETQALAVATLGTERDAQIIDELTGERSDHFLFHYNFPPYSVGETGMIGSPKRREIGHGRLAKRGVAAVMPTLAEFPYVVRVVSEITESNGSSSMASVCGASLALMDAGVPIKAAVAGIAMGLVKEDEKFVVLSDILGDEDHLGDMDFKVAGTRTGVTALQMDIKIEGITAEIMQIALNQAKSARLHILGVMEQAIPAPRADISDFAPRIYTMKIDPKKIKDVIGKGGATIRALTEETGTSIDIDDDGTVKIAAVDGNSAKEVMARIEDITAEVEAGAVYKGKVTRLADFGAFVSIVGNKEGLVHISQIAEERVEKVSDYLAVGQEVTVKVVEIDRQGRIRLTMKEVAPKQEHVDSVVADVAAEENA

SEQ ID NO: 45 - DNA, 633 bp, Pasteurella multocida
  CDS (2)..(631): purF
cgatggggtttctgtttatgctgcccgtgttcatatgggacaacgtttaggtgaaaaaattgcacgggaatgggcggatgtggatgatattgatgtggtcattcctgtgcctgaaacctctaacgatattgctttacgtattgcgcgcgtgttaaataaaccgtatcgtcaaggttttgtgaaaaatcgctatgtaggacgtacgtttattatgccggggcaggcattgcgagtcagttctgttagacgtaaactcaataccattgcttcagaatttaaagataagaatgtgttattagttgacgactcgattgtacgtggtaccacgtctgaacaaattgtcgaaatggcgagagcggcaggtgcgaagaaaatttattttgcctctgctgcaccagaaattcgttatccaaatgtgtatggtattgatatgccaaccaaaaatgaattgatcgcttatggtcgtgatgtagatgaaattgctaacttaattggtgtggataaattgattttccaagatttggatgcgttaactggttctgtgcaacaagaaaatccaagtattcaagactttgattgttcggtgtttacaggggtttatgtgacgggcgatattacacctgaatatctgga

SEQ ID NO: 46 - protein, 210 aa, Pasteurella multocida
DGVSVYAARVHMGQRLGEKIAREWADVDDIDVVIPVPETSNDIALRIARVLNKPYRQGFVKNRYVGRTFIMPGQALRVSSVRRKLNTIASEFKDKNVLLVDDSIVRGTTSEQIVEMARAAGAKKIYFASAAPEIRYPNVYGIDMPTKNELIAYGRDVDEIANLIGVDKLIFQDLDALTGSVQQENPSIQDFDCSVFTGVYVTGDITPEYL

SEQ ID NO: 47 - DNA, 4788 bp, Pasteurella multocida
  CDS (1)..(876): rci
  misc_feature (3084)..(3084): n is a, c, g, or t
gacgaggagagaaaattagctgatttggcaaaaggtatcgctccagatattatttttagagatgtaatagaacgctatcaaaatgaagtgtctataactaaaaaaggcgcgcgaaatgaaattataagattaaaccgctttttaagatatgatatttctaatctgtatattcgtgatttaagaaaagaagattttgaggagtggatcagaattcgcctaaccgaagtatcggatgctagcgttagacgtgagcttgttactatatcgtcagtgctgacaacagcaataaataagtggggatatatttcaaggcatccaatgactggtattgaaaaaccaaaaaactcggcagaaagaaaagaacgatattcagaacaggacattaaaacaatattagaaacagctagatattgtgaagataaactacccataacactcaaacaaagagtagcaattgcaatgttatttgctattgaaaccgctatgcgtgctggtgagattgctagtataaaatgggataatgtttttcttgaaaagagaatagtacatttaccgacaactaaaaacgggcactctagagatgtgccgctttcgcaaagagctgttgcgctaattttaaaaatgaaagaggtagaaaatggagatcttgtgtttcagaccacgcctgaatcattaagcaccacgtttagagtgttaaagaaagagtgtggacttgaacatctccattttcatgatacgagaagggaagcgttgacgagattatctaagaaagtagatgtaatgactctagccaaaattagcggacatagagatttaagaattttacaaaacacatattacgcaccgaatatgagtgaagtggcaaacttgttggattaattcactcttcttaaatacgccttttgccacttgattacatcgccagccttatatcttttactttcattacttcctttttctaatgaaactggggatggaaagtcttggcgggtaataatatgacgagatgtgtaattgtaagaacgattaatcatgatagaaatgtcttcaatactaagaagaactggactatcttctttaagttgagctaaggctccaaacctcacagagcgtagcacttcatcttgttgtttctttgttagagaaatattttccatttttacctcacttaaataaaaaagccgtcatggacggcttaataaagcatttcgctatacagttcttttgaggtgtacccaatatcgaacttgatttgattgttttgttttgcgatttccagtgcttcttttcgatcaacaaatcttccgaagttggtaataacaccctgtttcttaccaattagcggatattgtgtaccgttctcaatagatttaatttgtttacgcataaacatgtcatagtgtctcgcgccagtcactaaatgaagttcttttgttgtgtaatcttcaagctcgcacgcagcgcagacgattaattctggacgatctcccattttcctatctccgagcatttttcatagcctcaaaccaagcttgtgcgtctccttcactgtaaaataatgaaccgctttctagcatttttctgtgcttatctctattagcatcaaaatagaatctaataattgttgagttacctcttttaaagacctcttgattgtggtgtgctgttttgattggagcgggcaaagtaagcgttactgttgggcgtggttcttcccacattccgactatatcaaatggattttctaaatgcggatatttgttatgttcaaaaaaagaagatccatcaatcgtccaagaatttctctcaaattgtgtcttgctcttgccaatttgaaatacaccttgatataagaaagtgttgaacggaaagaactttgaataatcagcagttacatatcctttacttccatttctaagcacaactggctcaccggttaatgctttttctaagtcaaatgctttcattttttactctccagcttgctcatcaataagctcatcaatccattctcgaatttcagattggaaattttctaacgaattattttcattaaaataatctgcttcttttaacttactcaccgctgttttactaaagcatttataaaaaagacgcttttcttcaaacaaatcatcttttgagattgcgcatacttttcctacgccctctatacttttgtcttgaataaaactattaaaaagaacctcttcttgctgcttgttttctactaaaatagaaatcgtatatttttttggatattccatttttaatcctttcttttagataacaaaaaaccgcatttctgcggttattctgtgtatttatttaaaatattacttatagtttcagcatcttctaatgttaatttagaatagcttgaggtcatttttcctttaacggcaatcctcaattcttccagctttaagctatacaagtagtcttttttatctttataaatacgaccgtacaccattccggataatttaccttcttcatacccattagataaattgatctttctatctcgaccgcgcactctaattgttaaatattttcttccaatttttaagacttcagcctcatgttcaatgtttgagcgcatgagtgtttctaaaaaatatacggtatcgccaactttaagatttttaatccaatctttattcataaatacccttatactttcggtggcagtggaagtggttgccaatgagttactgaagatagatggtaagtacgaagagacataaagaaaacatcatctcgccacgcgatttttatttcccctctatctgtataaatcagaatatcctctctctcactgggcaatctatcttttacactaatccagccatcatcttgcgaaaattccacaatttctggcttttcaagcaccaaatcagagccgtaatcttctttttcctcttcgctcaactgcttttccttgcagtcagccttgccaaggacgacaccgtacacggcataaggtaaatcattcaacgcaaaatcctcatgatcacacatatcatctgcgaactcatgagcttctactgcaccatctaaacaactttgcttagcttgatntaatgtttcgtgtaagttaacgatatgtatgtcattagatacatctactgagaaaaattttttttctgtttctatcatagttaaattccttattcttttattaatgggcgaggaatcggttgccagtgtgtaacgttaatagctagatcataaattggaccattctgatttatagctacccaaaaatattcaccatcagcaatttctcttgatgcaattgcgtaatgctcgccatattcaccttcacaaaaagcaatgactggtgtttcaacttctggtaacttgtcatcaacactaatccagttgctatattcccaatgaaaattaagcttctcatagccattgatgacttgatctaacgcaggtcttaattgggtttctccaacaataatatgtgttgttatcttaatctctgggattccatctattacttcacaccagtttttttcaataaagtccaatctttttttatctgctaaaagactttcatattctgcttttgtgattgttactgtttctgtcatagttaaattcctcatgataaattccatgtttatttaccttttttctggcacaaaaaaacacgctattgcgtgctgtcttgattgatataatcaattaatctaagcccaatccatttcataactggaacagccatactgtttccaattgctttgtatcgtggagaatcagggcattcatctattgatttgttgcgatatgggattttagtgtaatcgtctggaaatccctgtaatctttcacactcacgcggcgttagttttctaacaactgattctactgataaagcaacgcaaggaacattattaccaccagttcccattcttgcttttaaggttggtgaaatatcatcgtgaatacgacaagcttcttcacccttaacctcaaatagaatattttccaatcctccatttcttccaatgcaatgcgctgtatttttagaaatgattggatcttgtgaaccgtgaacaacaaaagtttcactaccgccagcaagaactccaccgcttgctcttaatgttcccgcaacatcggatttgcgatattgagcaaagcttgtctcaataaaggcggcaatatcttttgcctgcgttccgctctgttcaatattccctcgcacgcttttggactcaatgagtatttgtgcaacacttcgttttctagcacttgccacaagaaacactcttttacgacgttgggcaactccgaagtattgagcatcgagaactcgccagcagattgttcggattgaatgcacataaccagcgttcgtccatcttctccctgtgtgctgcaatggctcacactcttgaaccagtccagccagaaggtgtccgaatgcgttgtccgaggtggatagcacacccggaacgttttcccacacgagaatgcacggtggtttgttgtcattgaatctaacatagtcgatcgcttctaaaattttaattaaaactaacgtgagatttcctcgctcatcgtctaaactttgacgattgccagcaactgaaaaagattgacaaggagtaccaccaactaaaacgtctggtgccggaatttcacgatctaatattttctgttgcaattcagtcatatcaccaagattgggaacgttagggtaatggtaagctaatactgcgcttgggaattgctcaatttcagaaaaccagagtggctctgcgaatt

SEQ ID NO: 48 - protein, 292 aa, Pasteurella multocida
DEERKLADLAKGIAPDIIFRDVIERYQNEVSITKKGARNEIIRLNRFLRYDISNLYIRDLRKEDFEEWIRIRLTEVSDASVRRELVTISSVLTTAINKWGYISRHPMTGIEKPKNSAERKERYSEQDIKTILETARYCEDKLPITLKQRVAIAMLFAIETAMRAGEIASIKWDNVFLEKRIVHLPTTKNGHSRDVPLSQRAVALILKMKEVENGDLVFQTTPESLSTTFRVLKKECGLEHLHFHDTRREALTRLSKKVDVMTLAKISGHRDLRILQNTYYAPNMSEVANLLD

SEQ ID NO: 49 - DNA, 1618 bp, Pasteurella multocida
  CDS (2)..(1195): sopE
gggcgatctatgtctgaaaatatctacatggtgtcaaagtcacagaatcaatcaagcaattcgcacaattcaaagtctatcaaccgcagtcatcggtattgtctgtactgcaaatgacgcagacaatgaaacattcccactcaatgaacccgttctcatcacaaacgtggcagcggcaattggcaaggctggaaaacaaggcacgctttcacgtgcgcttgacgggatttctgatgtagtcaattgcaaagtgattgttgtgcgagtgcaagaaagtgcgcaagaagacgaagaaacaaaagcaagtgaaatgaacacggcaattattggcacaatcacagaagaagggcagtacacaggcttgaaggcgttattgattgcgaaaaacaaattcggtatcaaaccacgtattttatgtgtgccaaaattcgacacaaaagaagtcgccacagagcttgcaagtatcgccgccaaactcaacgcatttgcttacatttcatgtcaagggtgtaaaacgaaagaacaagcggtgcaatataaacgcaacttctcacaacgtgaagtcatgctgatcatgggcgattttctgtcatttaatgtcaacacatcaaaagttgagattgactatgccgtcactcgtgcggcggcaatgcgtgcatatcttgataaagaacagggctggcatacgtctatttcaaataaaggcattaatggcgtgagcggtgtcacacaaccactctattttgacattaacgacagctcgactgatgtgaactatctcaatgaacaaggcatcacgtgttgcgtgaatcataatggctttcgtttttggggcttacgcacgactgcagaagatccattattcaagtttgaagtgtacacccgcactgcacaaatcttaaaagatacgattgcaggggcgtttgattgggcagtggataaagatatttctgtcacgctagtgaaagatattattgaagcaatcaatgcgaagtggcgtgattacaccacaaaaggctacttaattggcggtaaagcgtggcttaataaagagcttaacagtgcaacgaatttaaaagatgcgaagttgttgatctcttatgattatcacccagtaccaccgctcgaacagctaggctttaatcagtacatttctgatgaataccttgttgatttttcaaatcgtttagcatcgtaaggggtagaaaatggctttaccacgcaaacttaaattgatgaatttaatcatcgacggtaacaaatatctcggcgaagtcacggaagtgactcaaccaaaattagcaatgaaaatcgaagaatttcgcgcgggcggtatgattggttcggtggatgtcaatctcgggcttgaaaagctcgaagcggaatttaaagccggtggctacatggtcgaattaattaaaaaattcggcgggtcaatcaacggcattccattgcgttttcttggctcatatcagcgtgatgacacagaagaagtcacatctgttgagcttgtgatgcaaggtcgatttactgaaattgacagcggaaacagcaaagtgggcgatgacactgaacaaacattcaaagtgcctttaacgtattacaaaatcattgttga

SEQ ID NO: 50 - protein, 398 aa, Pasteurella multocida
GDLCLKISTWCQSHRINQAIRTIQSLSTAVIGIVCTANDADNETFPLNEPVLITNVAAAIGKAGKQGTLSRALDGISDVVNCKVIVVRVQESAQEDEETKASEMNTAIIGTITEEGQYTGLKALLIAKNKFGIKPRILCVPKFDTKEVATELASIAAKLNAFAYISCQGCKTKEQAVQYKRNFSQREVMLIMGDFLSFNVNTSKVEIDYAVTRAAAMRAYLDKEQGWHTSISNKGINGVSGVTQPLYFDINDSSTDVNYLNEQGITCCVNHNGFRFWGLRTTAEDPLFKFEVYTRTAQILKDTIAGAFDWAVDKDISVTLVKDIIEAINAKWRDYTTKGYLIGGKAWLNKELNSATNLKDAKLLISYDYHPVPPLEQLGFNQYISDEYLVDFSNRLAS

SEQ ID NO: 51 - DNA, 353 bp, Pasteurella multocida
  CDS (1)..(351): unknown C1
atgacattatttgatgaatgtaaattagctcttagagacgattttaatctaatttgtgatgaagagaaggattgtgtaatggataagttttatttctatttcttggaaaagaaagaggaatttaattttcaagattattcatttgaagaaatgtatatattttcaaaaatggaacctgtgtatgttttatgtgatagctctaatatacctttgtttaggagtaattgggaattgattatcaataatatatatgatgttgtctgtttatctacaaaagtattttttctagatgatgaaaagttaatgatggaattatttcctgaagataaagtaagagtcatctataaaagata

SEQ ID NO: 52 - protein, 117 aa, Pasteurella multocida
MTLFDECKLALRDDFNLICDEEKDCVMDKFYFYFLEKKEEFNFQDYSFEEMYIFSKMEPVYVLCDSSNIPLFRSNWELIINNIYDVVCLSTKVFFLDDEKLMMELFPEDKVRVIYKR

SEQ ID NO: 53 - DNA, 509 bp, Pasteurella multocida
  CDS (1)..(507): unknown C2
atgaaaaattttaggaatataaatatttatagtgattatggaaaggttgataaggaaattatattagaattcgaaaatgaatttaatataaagcttccttctttatacatagatttaattacggcgcataatgctccgaagagtgaagagaattgctttgaatattacaatgagcgtaatgagcccacgttttcttcctttggatttgaagggtttgagacagagcggtctagcgcctctcttgaaaatatatatgctcagtatatttatgatgatccaatctatggttatgaacatgtgtattcttttggtagtactggcgagggacattttatctgttttgattatcgtgatgatccaaaaggtgatgaacccaaaatctgtatcgtgattcacgatgaatatgatgaaaaaacagggaaaatgcgactgtttcctatagcagagaattttgaagcgtttttagatagtttgaaatcatttgatgaaatgatagagaagtattcgta

SEQ ID NO: 54 - protein, 169 aa, Pasteurella multocida
MKNFRNINIYSDYGKVDKEIILEFENEFNIKLPSLYIDLITAHNAPKSEENCFEYYNERNEPTFSSFGFEGFETERSSASLENIYAQYIYDDPIYGYEHVYSFGSTGEGHFICFDYRDDPKGDEPKICIVIHDEYDEKTGKMRLFPIAENFEAFLDSLKSFDEMIEKYS

SEQ ID NO: 55 - DNA, 443 bp, Pasteurella multocida
  CDS (1)..(441): C3
atgataaaatatttagagggaaatattaactcgtttatatcggcattaggtaaaaacgaaagtaataaagatattttaaaattagtagaaatagtttcttcagattttgaagtggatgaactaagtcataaagatgaacacgagatatattatttgttttataagaggggtgttgaattttgttttaaaagaatagatgaagagtatgtcttatattcggttttctttttcttggtagaggttgataattatttttcatgcccatttattcatgaattaatatgtgatcttaaacacggattctcaatagaggatattataaggtttttaggggagccaaattttaaaggtagtggctgggtaagatattcttataatggaagaaatattcatttcgaatttaatgaatctaatgaattatcccagattagcatttttattta

SEQ ID NO: 56 - protein, 147 aa, Pasteurella multocida
MIKYLEGNINSFISALGKNESNKDILKLVEIVSSDFEVDELSHKDEHEIYYLFYKRGVEFCFKRIDEEYVLYSVFFFLVEVDNYFSCPFIHELICDLKHGFSIEDIIRFLGEPNFKGSGWVRYSYNGRNIHFEFNESNELSQISIFI

SEQ ID NO: 57 - DNA, 8498 bp, Pasteurella multocida
  misc_feature: unknown C
gaattcgaattaagcgagaaaattgctgaaacactagaacaaagtcaattaaatattagtcaattatcaattgttgaaatttatcctttcaatgaagaacaagggatacgttttcataataaaagtgtggtacaacttaaaccagaagaggtggaatggtcatcaatccattatcttttctttgctggcgatattcagcaagtcgctcatctcgcgaaagccgcagaaatgggttgcgtggtgattgatatgaaagggatttgtgccagcttgcaagacgtccctgtggtgataccgggagtaaatcaggaaaaattggtagatttacgtcagcgtaatattgtgtccttagccgatccacaagtgacacaacttgcattagtcatcgcctcgttgatgtcaaatcacgaaatcaaagacattgccgtaacctcgttattacctgcatcttatactaacggagaaacggtaggtaaattagcgggacaaacagcgcgattgttaaatggcattccacttgatgaaggcgaacaacgtttagcttttgatgttttccctacgcctgcatcgcatttaaatatgcaaattcacaagatctttccacaattagataatgtcgtatttcattctatccaagtgcctgttttctacgggatggggcaaatggtgagcgtattatcggattatgcattagatcctcaatcttgcttagcgagctggactgacaatccgttgatgacttatcatgcagaaaaatattgcaccccagtgacgaatggcgaacaggaaatggcagaagagcaagcagcaaaattacatataagtgggttaagtgcggtggaaaatggtctacaattttggtcggttgcagatgaacagcgctttaatcttgctttattgagtgttacgcttgcagagttaatttactcgcaaggttattaatttaaatgtgtttttgcacgatatttttatcttgaactttgagagcgcactcgtttttgacgagtgcgtttttgttaaaacattcgtttgaaagacagtgaatgaatagcggagttattgataagaatcaatttatacaaaagcaactgaatgttattaatcgaggcaataaacctattgatagttttagttggcgccataatacataaactgtacttaataatatgcaatcaatacctagaaatattcatgacgtaatccaacatatcggggaggggattttaagtgatggtagaaaaaacatttagaaatctaaaaatatatgatgattatggttctgtctctcaggaaattatttttaattttgaaaaagagtttgatataaaactccctttatcctatatctcacttgtgaaaaagtataatggcgtttggtttaaggaaagtgattttgaatatttatctcaaaatgggaaaagaataataagctcattgagttttgatagttttgagacaaaagataatatcgaaccaatgaataatatattaagacaatatatttatgatgatgaaatttatggatataagaatgtttattcctttggttacactggaaatggtgactttgtctgttttgattatcgtgatgacccaaaaggtgatgagcccaaaatctgtatcgtgattcatgatgaatatgatgaaaaaacaggcaagcgtttgttattgcctgtggcagaaaattttgaggcatttttagatatgctttacgattttgatgaacgctatccgaatggttatgaataggtatttgtttaaataatgtgttgtattttttaagcattatttacaactaacattttaagtgcggtcaattttgaaaaagttttgggctttgagaattgggcgcattttttttgaaatattcttcaatgatgagcactaattatggattagataatgggaattatcgagatatggatggtaataaaggatggaggctagattttgatcctgagaaagttgttcatgtaaatatttttgactttactaaaggtaaaggactaggtaaagcagttaaaaagtcattctttttgatagtactgaacaagagtttgaaaaattttaaagcaattaaataaggaagataaaatgacattatttgatgaatgtaaattagctcttagagacgattttaatctaatttgtgatgaagagaaggattgtgtaatggataagttttatttctatttcttggaaaagaaagaggaatttaattttcaagattattcatttgaagaaatgtatatattttcaaaaatggaacctgtgtatgttttatgtgatagctctaatatacctttgtttaggagtaattgggaattgattatcaataatatatatgatgttgtctgtttatctacaaaagtattttttctagatgatgaaaagttaatgatggaattatttcctgaagataaagtaagagtcatctataaaagataattaccccttgatcgcgctcgtgtcagcacgagttcgctttcattaaagctctcgttaaagactagcactagcagtgaggttgatcgtaatcaatttactgaagaacagttaattaaaattaataagaggcttgataaaatagagggatttacatggcatcataactcacaaagtagtccccaaaatatgtagttaatacctacaccaattcataaggctgttcagcatataggtgaaggcgctttaagtgaaggaaagtgataaaatgaaaaattttaggaatataaatatttatagtgattatggaaaggttgataaggaaattatattagaattcgaaaatgaatttaatataaagcttccttctttatacatagatttaattacggcgcataatgctccgaagagtgaagagaattgctttgaatattacaatgagcgtaatgagcccacgttttcttcctttggatttgaagggtttgagacagagcggtctagcgcctctcttgaaaatatatatgctcagtatatttatgatgatccaatctatggttatgaacatgtgtattcttttggtagtactggcgagggacattttatctgttttgattatcgtgatgatccaaaaggtgatgaacccaaaatctgtatcgtgattcacgatgaatatgatgaaaaaacagggaaaatgcgactgtttcctatagcagagaattttgaagcgtttttagatagtttgaaatcatttgatgaaatgatagagaagtattcgtaatgtctccgttcatatctcatagcgatgctctctcccctgattttatggaaattttgtttaaattaggagggcactaaaatgaaaaaattttatttaatttttttattattcctaagtggatgtttttatcatgatggatgtatctatactcctcagatggtaaattgttttgttgataaaggagatatatttccatcaatatctcggtatcaaaagccttatagtctaggaaaaaccaattcagaacagcgttggaaggatgttatgttttgtggaggtaaatatggtgattataaattagagaatataaaaacagtggaacaatcggataaattacatcattgtatgacccaaaaagggtatatccatttaactcccgcagaatgtggataccaaaatcctaaatgggataaaggcgtttgtaatttataagtgttttggattttactttacgaattttttttgaaaaaagttaccgcaggtatgtttttaatcaaagcccaggtggcgcttgttggatgtgttattcgcatagtagttattatgcggaagtgctaaatgaattcattattaaaaatggaattaaagagcgtaattagcaccgtttgcggtgagtgatttaatttctcctgatgttatggaaatattatttaagttaggaggtgattaggatgaaaaagttgttattgttcagtttattattacttttaaatggatgcctatattcttttgaagaggagtgttttagaccgttaattcaggtggggtcatctgcttgtcataagaataaaggagatatatttccatcaatagcacgtttccaaaaagtagagaacatcggaaaaactgatgccaagcaacgttggaaagatgcggttgattgtggaagtaagtatggcgatgaagatttaatatatataaatgataataatttatatagcatttttcactcctgtatggttaaaaaaggatataaaaagtttcatcccgcagaatgtggataccaaaatcctaaatgggataagggtatttgtaatttataagtgttttgaattttactttacaaactttttttgaaaaatgttaccgctggtatgtctgtttttagggataaagattcgttcattttctttaaatttaggcacggtataaaagagcttgattatcaaataataatatcgtgttcgtgtccacacgagtagggtttgattaaagtactcctcaaaagcgagtgctagctgtggggtaaacggtgggaaagaaagtaaagagtatataaaccaattgaccgcataacgtgcggtcaatttctaagatttatgagttccagaaaaatagaccgaaaagtgcggtaaaggggtaacgaaacacaaaaaataaaaatatgacagcaagctgtgtcattaaaccccagaaaaaaacttgaccgattgttgcactgctgaaaatggcaaaaagtaagccgatttcatagggtagcattgcaataaaccagattaatccacttggatgatcacttttcattacggactccttatttatggctgataacttaacacttgtattgaaaattaaagcagatttaaacaatgcgttgagcgattttaaagcgcttaaaacggaattgcaacgcgcaggcgtggagtctatcagtaagtaactcgccagtttttgcaatcatttatcatattcacaaagccgtaatgcatattggagaaggttaagtgtaagtgaaggaagataaaatgaaatttagacattttggcatttattatgattatggcgtagtttcccaagagattattttagattttgaggaaacgtttggtattaaattaccaaaattgtatattgagttgatcacaaaacataattccccaagattgaatagagatcatttcaattattatgatttctctacgagtgaggaagaaggaacggaatttatattcaaaggatttgaaacagaaagtaataggcatgcgccgccagaaaatatttatgcacaatatctttatgatgatgaaatatatggttatgaacatgtgtattcttttggcagtaccgctagtggtgactttgtctgttttgattaccgagataatccgaaaggcagtgaacctaaaatttgtcttgtgattcatgatgaatatgatgaagaaacaggcaagcatttattgtttcctgtggcagaaaattttgaggtatttttagatatgctttacgattttgatgaacgctatccgaatggttatgaataggtatttaaataatgtattgtattttttaagcgttatttaataacgttttaagtgcggtcaatttcaaaaaagttttgctttgaggaattgaccgtttttgtatcatggatatgatgtgagcaattgatatcctgtttgtgttaactggcatgtggtaaagcattcgtcaaagacgagctctagtggtgagggactaatcatgaatgaactattggacttttatagaaatataactttttttgaagaatatgatgaaaactcattcataggaagatggcttgattactcggaatggaatgataaagaatattggaaattagagaaagatttactgaaaattgctcaaatgtatagaactactaatgaagtttttccagatattttaataggggttatgcgtatcattgaattattaatgatacctaactggaatagttttataatatctaattcagaaagtgttgatatttatgatagatatgaacgatttaaatatataatttcaatacttttcaataataaagatgttagactagatggcttttcatatacagaaaagaatgatgatgtattttataatgaatagaaaaattaaaagtaagctaatttgtagaaataataaaagtctcgcttgtattttttctttgagatcgtgcttgagtccacacgagtgctagctgtaggcagagtgtcttggtgattataaaaagttaaggatagtattgttgatatgaaagaaaagactaaatattcaatggggaatcaaagtgataaaaaataaattttatatttcttggttaggattttcaatatcattatatgttttgcttttatgtagagatttgttttattctctttatatgttttttattatgatgtatttgtcttaaaattttcttttaaggaggcgttttttactatctttatttttattgtgctatgtttcattattcattattcattattcattattcattattcattattcattattttatatataaatatggtaaaaggtctgaatgcccaaaaaagaaaccattaagtgaaaatgtaacatacaataaaaggtagtaggaataaataaaatattaggaataacagaatgataaaatatttagagggaaatattaactcgtttatatcggcattaggtaaaaacgaaagtaataaagatattttaaaattagtagaaatagtttcttcagattttgaagtggatgaactaagtcataaagatgaacacgagatatattatttgttttataagaggggtgttgaattttgttttaaaagaatagatgaagagtatgtcttatattcggttttctttttcttggtagaggttgataattatttttcatgcccatttattcatgaattaatatgtgatcttaaacacggattctcaatagaggatattataaggtttttaggggagccaaattttaaaggtagtggctgggtaagatattcttataatggaagaaatattcatttcgaatttaatgaatctaatgaattatcccagattagcatttttatttaataatttaggattgggaacgctctcgtgttcacacaagtgcggtttgattaaagcacttgtcaaaggcgagatccagctgtgggagatttgatagagaaatggctctcaggattgacgttagtagagggagcataaatcaagaaaaaacatttaaaataggaacattaggtggtgagtaatggaaatcactcgttttaaaatcctacttattgccttgattatattaggtaatgggtatgtgtttcttggtggaccagctaaaaaacaattcgctatagaagcagaaacaaggcggatttatcgtactttaacgaaagaaattatttttatgaatggagaatataaacaatttggagggcgagttattcaaggatttactttagtcatttctttttctcattcaagtacagaaaaccgcattaagattttagaaaaaattaaagagatgggatttgattcaaaaaataaaacatcaaaaccgagtcttcatcttttttgtcaaggagaaagtggttttttgatcgcagaaaaacctgaatttagaatagattatgagaaaaagatgacttattgtttggagtagcaaaggaaggcaatgataagtgtattttctaatcagatttaatttaagtattaaagtgcggtcaattttgaaaacgttttactttgaaaaattgaccgtttttttacatgagagagtgaaagtacaccaccttaggcaatgtggttgtggataaggtgattaaggaatacccaaatgggggttatgaagcgagggtgctgatccctaacccgaaagcgaaaaccgatcctgatgcgccgaaatttttggagaaaaggggaaatgaaggtgtatccacaatgtttccaagaacatggacagaggataggttgaaagtggagttagagcatgcgtttaataatagagtaccaatggaaaagtttgaaaataaatgggaaggtataacaaaatcaggcgtgaaagtagaatgggttctggatagaaatggtaaagtgttgactctattttgttaattttctgtgtctttttgtaaaaaataagttgttgaaataacatttttctctataatcaaatcttaatgataattaatatcattaaataagaatggatacttagatgaggattatatgaaagatttatcaaaaatgacctgccttgaagacttacgccgtgttgcgcaacgtaaagtgccaaaaatgttttatgactatgtagtttcaggatcttggagcgaaagcacattgcatgccaaccgtaatgattttcaagcaattaagctacgtcgacctgtggcgattttgcccatttctgcattcagctctgcaattcgtcgcttgtgctgttctgttgcgcgcgcaagctctcttgtcgacttgccttttctaattgggcttgttgctcccaataacgtgaggtcgccacatccactttacgtagtgttga

SEQ ID NO: 58 - DNA, 5798 bp, Pasteurella multocida
  CDS (2686)..(4446): unknown D1
gtcgacaagaataaaacgaaacagcaaatagaattagaattactacttattaacaataatccttttttaaagattctagctgttttagataaaaatatacgtgtgaagcttttggtcacattattattatcaggcctatattatttatatgcagtaaaaaacgattcaaattttgtcataggtttatctattattttagtttttattattgtcattccagggattttgacaaatgctattttgaaagctaaggtgaaaaaaatcatggtagatttaccaggttttattgacttagttgcagtaaatgttcaaacagggattagtattgatgcggctttaaaacaagtggcaatcgattttaagaaacttaatccagatcttacttatgtgatgttaaggattattagaaaatctgaacttacgggattatcacaagcgttacaggatctttcgatctcattgccaacaacagaaataagaatgttttgtactgttttacaacagagtttaaattttggttcttcaatttattctcacttaattcagttgtctgcagatatcagggagatacaattattaatcattgaggaaaagttaggtacattatcagctaaaatgagtatcccattgattttgtttattatgttcccaataatcattttaattctagcaccaggtataatgagggtatttccaaatgttttttaaatttaccaagaaaatcgtttttgttagtttagctttatctgtcgttggttgttctacccattctcagcaaggcatgacacagaaaagtatgtcatctgaaacaataacggcaaaagagactttatatgaaagtacgcaaaattattcggcactcatttcactgtatcgcgatgtgttgaaagccaaagaagatccttcaatacgctataaattagcgaagacatactatcagcgaggtgacagcaaatcttctttactttatttaacgccattactgaatgataatacgaagcttgctacacaagcgaaaatattacagataaaaaatctaattcaattaaataatttccaagaagcaatttctgtcgcaaatgaactcttattaaaatcacctaatgaaggagaagtatataatttaagaggtatcgcttatgcgcaaaatgggaatttggtgaatgcccgaaatgatatcaataaagcaagagagttctttattaatgataatgttgctattaataatttagccatgctaaatattattaatggcgattttaataatgctgtttctttactgttgccacaatatttaaatggcgttaagaattctcgattgattcataatcttgtttttgctttagttaaaaatggtgatcttgattatgcaaaagatatcattgttaaagagcgtttaaatacttcaccagatgatttaattaatgcattgaaaaaaactacacatgtatcaaaaggtgtaactcggtaacactaaggatttgatatgaaaaagtttctatcaaatataaaaggaacctcgtcaattgaatttgctttgacgatagcgttctatttatttgttgtgatgtttatttttgaattttgtcgattagcggttgcgacagcttattgggatttagctataacggaaagtgtcagaattgcgaagaatgaacaagcaatttctggaaattatgaagaagcatttaggaaagctcttacaaagcaaaaaaaattccatgatgaatcgacaattggatatttggcgttgttagaagataataaatttgatgtaaaagtccaatatgtggattgtgataaagaaacggaatgtattaaaaatcttctgcttaataaatttcgccaaccacaaaaaaatcataaaggagagttaatctctcctacggggagtcgcgcgactttagcacaatattctttaacttataaatataagtttatggtgccgttagtatttattcctgagtcttggtctcaagtagtgctgaaccgtgaatttgttgttgtacaggaatttgagcgttctcaatttatgttaggagcaaaaccaagttctcttgggacgaatccatagaaaatttactcattatttcgagctatatatgaaagagtcaggtttagttaaattcaagcatttttggaaaaataaaaagggcgcagtgacgatagagttcctttttatgtcaatgtttctgattgtgctatttgcatttctcttcgatttagtaatgttacgttctacattaggcaagttagataatgcctcatatacattagttagtattctccgtgaacgtacacagttgtacgatagagttgcacaaattaatattgatgatcataagcaatttgaaaagcttgctaagaaactgatttatggtgatcagaatagtaataaaaggatcgatgttgttttagaatattgggcacaagacggttctggacggaggattccaaatatcattggcgattgtacgccttacaaaaaactttctgatttatcctatttatctcctcgctcagaactcaataatgaaagaaaaataccgctttatcaaattactctttgtgttgaaactcagggcttgtttgaaacaatattactggataagtctgagcgttcaacggggctgattagatcatcgtcaatgtcagtatcacgataaattatcgttagggaactttatgaaaaaactttatttaattcgttcttgctatgattcagtcagaaaattttatgagaatgagctaggtgtttatacagtaatgactgcattactagcatttccattattagttttgattggatttacggttgatggaactggggttgtgcttgataaagcacgtttagctcaaggaatggatcaagctgctttagctttggttgctgaaaacaatgactaccgagaaaataaaaaacatggtgatgttaatcggcaagtagtatcgcctcaagacaaagcaaaatttggtggtaatgaatttatggcgaaacaagaaaagcgtaatcaagagcttatccagggtattgccaaactttatttacgttcagaaaatgcgaatgcttcatctgatgcaccaatcactattgataaaccttttcattattcatgtgaggagttagatttacctacagctaatgagtatgcacgtcgtaaacctattgtttgtgaagtgcaaggtggcgtcaatcgtaaattttggcttcctgtcagtgaatcgttagttagtgaagataaactgaaaaaagatcgagttagactggaatccgataccagttatgcgattaaagaaaaaggcatcgtgattcctgtggagctaatgcttgtttcggattattctggttcgatgaatagtcatttacaggataaaaacggtagatctctaggaaaagctaaaattactattttaagagaagtggttagtgaaatttcgaaaattttattgccagaagatgttagcgaaggtgtgagccctttcaaccgtattggctttacgactttttctggcggtgttagacaacgggatgtcactgaaggctgtgtgcttccatatgaaggaaaaatatcacaaacttctcgaaaattaactattcgttattggattacgggtaataatacaccttggaaatttaatgctgggagatgggagagaagtacagtgtctttccaggagcattataaaggctattatgacaaattccattcttcaacttgtagaggctcagggagctctagaacttgtcaaattgatgcaaatcctaagaaaattatggattatgcactaaaaattaatgactggacgacaattagagaattatttaatacttatatagatgtaagtgggacgattgaccaaatttcccagtttgatggttcaaacagacgttatgatatggtgtttactgatgaagaacggtgtcttggcggaaatattggtagaagaacaactcgagcttggtttgatcaaaaaaataaagatattacaagagagttgaatattgttcgtccttctggttggacttctgcatcttcggggcttcttgttggagctaatatcatgatggacgagaataagaatcctgatgcgcaaccttcgaaactcgggacaaatattcaacgtgttatcttagtattatctgatggtgaagataactggccaacttatagtacattaacgactcttttaaacaatggtatgtgtgacaaaattcgagaacaattgggcaagttacaagatccaaatttacgagagttaccaggaagaattgcgtttgttgcgtttggctatagtccaccagcaaaccaagttgccgcttggaaaaaatgtgtaggtgatcaatattatacggcttattcgaaagaagagttgttagatagtttcaaacaaattattggatttgaagaagaggtggggcgttcttcatctcataaaccgaaattttaagattgtccaaggataacgctaaaaaatctcttagcacaggctaagagatttttttatgtgtttttcaaattttatctactggtgattttaattcattacataacataactttttcgtgaataatacagaatagacaacaataagaattaaaacgctcaaggcatagaggcttagtcgaacaaactaagctattttgcgcgattgattgggatatagatgttatttcaaataagcaataaccatggtactgagaaagaagatgagtgccgtaataaagtagaagcgatttttcttttggctgaaaggtggtgttagcctttttcggctaaagaaaatagtagcaacggcaatataaagggcgataaagagcattttgtaaatgaaccatgttgttacattttgctgaaaaagaagaaatagcccaattcccgaacagaacaacagcgtatcacttaagtgcggtaagatttttaatacttttctgtctcgccaatttttgcctgttaattgcatcatgccacggataataaatagactgaggctgagaaaggcacaggcaatgtgtagataaataagataatatgccatcgatttttttcctaagataaagaaagcagtagcgaggctactgctttaaaataatatcgtatttagtgaatgaatttaactttctgcgctttcgaccgcactttcgctcgcatcactctcaatgtcttcttcatcgacatcacaaacgagttgtaatccaaccagtgtttcactttcacttgttcggatgagacgtactccttgtgtatttcgaccgataatattgatttcgtttacgcgagtacgtactagcgtaccggcatcagtaatgagcataatttgatcgctttcctcaacttgtgttgctgcaacgactttaccgttacgctcactcactttaatcgagatcacgcctttggtgttacgtgatttagttgggtattccgctaattcagtacgtttaccataaccgttttgtgtggcggttaaaatggcgccttcattttttggaataacaagtgacacgactttatcaatattgagatccaaggcatcattagtattctcatcagagatctcttccatatcgaccgcactttcatcatccgacaaatcattcgttaacgccagtttaataccgcgtacacctgttgctgcacgccccatggcacgcacagcattttcactaaagcgaactacacgtccttgtgcggagaagagcatgatttcattttgaccatcggtgatatccacaccgataagttcgtcttcatcacgcaagttgagtgcaataatgcctgttgaacgaggacgactgaatt

SEQ ID NO: 59 - protein, 587 aa, Pasteurella multocida
MKKLYLIRSCYDSVRKFYENELGVYTVMTALLAFPLLVLIGFTVDGTGVVLDKARLAQGMDQAALALVAENNDYRENKKHGDVNRQVVSPQDKAKFGGNEFMAKQEKRNQELIQGIAKLYLRSENANASSDAPITIDKPFHYSCEELDLPTANEYARRKPIVCEVQGGVNRKFWLPVSESLVSEDKLKKDRVRLESDTSYAIKEKGIVIPVELMLVSDYSGSMNSHLQDKNGRSLGKAKITILREVVSEISKILLPEDVSEGVSPFNRIGFTTFSGGVRQRDVTEGCVLPYEGKISQTSRKLTIRYWITGNNTPWKFNAGRWERSTVSFQEHYKGYYDKFHSSTCRGSGSSRTCQIDANPKKIMDYALKINDWTTIRELFNTYIDVSGTIDQISQFDGSNRRYDMVFTDEERCLGGNIGRRTTRAWFDQKNKDITRELNIVRPSGWTSASSGLLVGANIMMDENKNPDAQPSKLGTNIQRVILVLSDGEDNWPTYSTLTTLLNNGMCDKIREQLGKLQDPNLRELPGRIAFVAFGYSPPANQVAAWKKCVGDQYYTAYSKEELLDSFKQIIGFEEEVGRSSSHKPKF

SEQ ID NO: 60 - DNA, 5798 bp, Pasteurella multocida; identical to SEQ ID NO: 58
  CDS (698)..(1468): unknonw D2

SEQ ID NO: 61 - protein, 257 aa, Pasteurella multocida
MFFKFTKKIVFVSLALSVVGCSTHSQQGMTQKSMSSETITAKETLYESTQNYSALISLYRDVLKAKEDPSIRYKLAKTYYQRGDSKSSLLYLTPLLNDNTKLATQAKILQIKNLIQLNNFQEAISVANELLLKSPNEGEVYNLRGIAYAQNGNLVNARNDINKAREFFINDNVAINNLAMLNIINGDFNNAVSLLLPQYLNGVKNSRLIHNLVFALVKNGDLDYAKDIIVKERLNTSPDDLINALKKTTHVSKGVTR

SEQ ID NO: 62 - DNA, 1788 bp, Pasteurella multocida
  CDS (1)..(600): unknown K
gtcaacactgggctaattcacagtaacggtaatgccaagctcacttttaaagatgacaccagttttgtgactgaaggaaataactttatcacagcaaaagacaacttagaaatcacggcaaaaaatgttcaaattgatcaagcgaaaaatattcaattaaacgcgaatatcacgatcaataccaagtctggttttgtgaattacggtaccttagcaagtgctcaaaatttaacgattaataccgaacaaggcagcatttataacataggcggtatcttgggggcgggtaaaagtttgaatctgagcgcgaaaagaggagaaaaccaaggaggatatcttattaatcaaggtaagagtctactccattctgaaggcgccatgaacctcacagcggatcgcacggtgtacaatttagggaatatttttgctaaaggtgacgcgacgatcaatgcaaacgcgttaattaatgatgttactctcacaggtcgtcttgagtatcaagatctgaaaaaagattatacgcgttattatcgtatcaatgaaacggcaaaacatggttggcataataacttctatgaattaaacgtcgacagagtttcttgatttgtgcatcaattttgtaaccaccggttaataaaacaccagcaatttcaacgccattcatggcagataatgccgctgcgacgatcacatcaggacgatccgcggaagtgacaagtaaacttccaacgcggaaatgttccaccatattggtcaaattacgtgcacagaaagtgatgccacgaatgcgacgttcattgatcgcgccttcatgaataatggcagcacctaaatgtttggctaaatcaatggcacgagtcgcaattaattctgcgctccaaggaatacatgccaagattttaattgggcttttctcaaataaatgataaatctcagatacttgattttgtgtgtgttggaaagaatcaaaaatttctgccaagtcagggcgagtacgaccagattcatcaatcggcgcattaaatttattgatcacaacaccaagtaaattagggttatttttgctgccaaataatgaggctgcggctttgatgcgttctttgagttctgccggtgtttccgtcgccggtgctgcaacaagaatgatttccgcatcaagtgcttgagcaatttcatagttaatgctattggcataagaatgcttacgcgtagggattaaaccttccaccacgacaatttcattgtttttggcgagttgttgatgattttcaacaattttttctagtaccacatcagattgattttgaccgatgagtgattcagctacacttaacataaatggttcactggtttcaatggtggtactggtgcgaataattgatgttgtgcgatcaatcatatcttcacctgagttcggctgagaaattggtttcataaagccgactttcgcccctttttgctccagtgcatgtgttaaacctaagctgacactggttaagcctacaccagcactaatcgggataaggataattgtacgtgacataataaaccctaatttgttgataatttatacaaaaagaaactgccgatgaatcggcagttaattgatctttacgcgatgcaaaggcgcgcggtatcttgtgcaataacaagttcttcattcgttgggatcaccatggcaacaggcgtattgtctgctgtaatcaccccttcatgaccaaagcgagccgctttgtttttatctgaatccacttgataaccgaacagttttaaatggtttaaggttga

SEQ ID NO: 63 - protein, 200 aa, Pasteurella multocida
VNTGLIHSNGNAKLTFKDDTSFVTEGNNFITAKDNLEITAKNVQIDQAKNIQLNANITINTKSGFVNYGTLASAQNLTINTEQGSIYNIGGILGAGKSLNLSAKRGENQGGYLINQGKSLLHSEGAMNLTADRTVYNLGNIFAKGDATINANALINDVTLTGRLEYQDLKKDYTRYYRINETAKHGWHNNFYELNVDRVS

SEQ ID NO: 64 - DNA, 278 bp, Pasteurella multocida
  CDS (108)..(278): unknown O
gaattccaaccaaatctcacaccagagcaagaacgctacatagtggaatggttggcagaacattacccaaatggaaataaaccttaaccatagcaagagagaagaaaatgaaaattactattacacgaaatcatccagaagtatttcaagaatccgctcgtttagtagccgaaaagttcattaaagcccaatgtgtagaagcattaacattggctttgattgagggtgtcgagcactttgtgctggaaggtgaggaggaaagcaaaaggggacatagt

SEQ ID NO: 65 - protein, 57 aa, Pasteurella multocida
MKITITRNHPEVFQESARLVAEKFIKAQCVEALTLALIEGVEHFVLEGEEESKRGHS

SEQ ID NO: 66 - DNA, 1020 bp, Pasteurella multocida
  CDS (1)..(597): unknown P
gtcaacacatcaaaagttgagattgactatgccgtcactcgtgcggcggcaatgcgtgcatatcttgataaagaacagggctggcatacgtctatttcaaataaaggcattaatggcgtgagcggtgtcacacaaccactctattttgacattaacgacagctcgactgatgtgaactatctcaatgaacaaggcatcacgtgttgcgtgaatcataatggctttcgtttttggggcttacgcacgactgcagaagatccattattcaagtttgaagtgtacacccgcactgcacaaatcttaaaagatacgattgcaggggcgtttgattgggcagtggataaagatatttctgtcacgctagtgaaagatattattgaagcaatcaatgcgaagtggcgtgattacaccacaaaaggctacttaattggcggtaaagcgtggcttaataaagagcttaacagtgcaacgaatttaaaagatgcgaagttgttgatctcttatgattatcacccagtaccaccgctcgaacagctaggctttaatcagtacatttctgatgaataccttgttgatttttcaaatcgtttagcatcgtaaggggtagaaaatggctttaccacgcaaacttaaattgatgaatttaatcatcgacggtaacaaatatctcggcgaagtcacggaagtgactcaaccaaaattagcaatgaaaatcgaagaatttcgcgcgggcggtatgattggttcggtggatgtcaatctcgggcttgaaaagctcgaagcggaatttaaagccggtggctacatggtcgaattaattaaaaaattcggcgggtcaatcaacggcattccattgcgttttcttggctcatatcagcgtgatgacacagaagaagtcacatctgttgagcttgtgatgcaaggtcgatttactgaaattgacagcggaaacagcaaagtgggcgatgacactgaacaaacattcaaagtgcctttaacgtattacaaaatcattgttga

SEQ ID NO: 67 - protein, 199 aa, Pasteurella multocida
VNTSKVEIDYAVTRAAAMRAYLDKEQGWHTSISNKGINGVSGVTQPLYFDINDSSTDVNYLNEQGITCCVNHNGFRFWGLRTTAEDPLFKFEVYTRTAQILKDTIAGAFDWAVDKDISVTLVKDIIEAINAKWRDYTTKGYLIGGKAWLNKELNSATNLKDAKLLISYDYHPVPPLEQLGFNQYISDEYLVDFSNRLAS

SEQ ID NO: 68 - DNA, 2584 bp, Pasteurella multocida
  CDS (1042)..(2286): xylA
gtcgaccagcttagattttgcgacggggttaatttcttctatcgtttcaatcattgcgtttaccattattttatggaatctctctggaccgatgaccattgccaatattgaaattcctcacgcgatggtctttttggtctttatttacgtgctgtttagcagtattgtggcatttaaaatcggtcgcccgttaattcagctcaattttgccaatgaacgcttaaacgccaactaccgttattcacttatccgtctgaaagaatatgctgaaagcattgctttttatcgtggtgaaaaaatggaaaaacgtctattgaccacacaatttaatcaggtgattgataacgtttggcaagtaatctaccgcaccttgaaattatccggttttaacttaatcattacgcagatttcggtggtttttccgctggtgattcaagtgacacgttattttcgtcgacaataggtgcatatgagggtgttagaatagcgatactttctgttggaaaagtaaactctttaatataaatagaaatcgcttgaatgattctcgggcaaaaaataatgtactcatttgcgatctcatactgataatggcgaagtaaatatcttcttacaatattatggtaattatcaggtaataccgtatagccatagattccagttctattttgttttgctaaataattgatgagcatttgaggcgcaggtaaatccatatctgcaacagacattgaaatcatatccttgccgtatttacgagtaattgcccatttagcactatgacaatctgatctatcagtaaaaacatcaaacaaattatccgtcatacatgttctccaatattggatttatataaactttagaacttgaggtagattgttggaattgttaaatctggtatttctattacgttttttcttttttgtgatataagccacaataaccaataatcttaattgttaagtgaaataacgtaattgatcctcccattgttttactaaattatgtctctgaaacttatttgttcaggagaaatcatttatgtccacttacttcgacaaaattgaaaaagtaaattatgaaggtgtaacttcatctaatccgtttgcatataagcattatgatgctaatcaagttattttaggtaagacgatggctgaacacttacgtttagccgtctgttattggcacactttctgttggacagggaatgatatgttcggtgtcggttctttcgatcgttgttggcagaaggcgagtgattcattagcaggtgcaaaacaaaaagcagatatcgcttttgaatttttcagtaaattaggcataccttattattgttttcatgatgttgatgttgcgccagaaggtcattcatttaaagaatatttgtcgaactttaatacaatgatcgatgttttagcgcagaaacaagaagaaacaggcgtcaaattgttgtgggggactgcaaattgttttacacaccctcgttatatgtctggtgctgcaacaaatccgaatccagaaatttttgcttgggctgctgcacaagtatttactgccatgggggcaactcagcgtttaggtggtgaaaattatgttttgtggggaggacgtgaaggatatgaaacgttattaaataccaatttaaaacaggagcgagagcaaattggacgtttcatgcaaatggtggttgagcataaatataaaatcggttttaacgggactttgctgattgaaccaaagccacaagagccaacgaaacatcaatatgactatgatgtggcgaccgtttatggctttttaaagcagtttggtttagaaaaagaaattaaagtgaatattgaagctaatcacgcaacattagctggacacactttccagcatgaagtcgccatggctacagcgttagatatttttggttctattgatgcaaatcgtggtgatccacaattaggttgggataccgatcaattccctaatagcgtagaagaaaatactttggtcatatatgaaattctcaaagcagggggctttacaaccggtggttttaattttgatgctaaaatccgtcggcagagtacggatccttacgatttatttcatggacatattggcgcgattgatgtacttgccttatcactaaaatgtgcggcgaaaatgcttgaagagcaagctttacaaaaagtcgtcaatcaacgttatgctggttggacatcatcacttggtcaacttgttcaaatccggtcctaccacgcgtgtctgcaatacagactaacaaaagtgctttaaaacgttccggcttacgccagacatctagacgattgaataatttcaatattgtctccgcacgtaattcaaaggctttgtgtatgtgcgaatgatattcacaacaaagttctgcaaaatcttgaattgcgtgaggtaatttaaagcgctgacataagcgtcttgtcggcatgacaccagctttttcatgtccataatgatgtggcaatatttcttttggtgttaaggcttttcctaaatcatgacaaattgcagcaaaacgtaccgcacttttgtcactgtccgtgttttctgtcga

SEQ ID NO: 69 - protein, 415 aa, Pasteurella multocida
MSTYFDKIEKVNYEGVTSSNPFAYKHYDANQVILGKTMAEHLRLAVCYWHTFCWTGNDMFGVGSFDRCWQKASDSLAGAKQKADIAFEFFSKLGIPYYCFHDVDVAPEGHSFKEYLSNFNTMIDVLAQKQEETGVKLLWGTANCFTHPRYMSGAATNPNPEIFAWAAAQVFTAMGATQRLGGENYVLWGGREGYETLLNTNLKQEREQIGRFMQMVVEHKYKIGFNGTLLIEPKPQEPTKHQYDYDVATVYGFLKQFGLEKEIKVNIEANHATLAGHTFQHEVAMATALDIFGSIDANRGDPQLGWDTDQFPNSVEENTLVIYEILKAGGFTTGGFNFDAKIRRQSTDPYDLFHGHIGAIDVLALSLKCAAKMLEEQALQKVVNQRYAGWTSSLGQLVQIRSYHACLQYRLTKVL

SEQ ID NO: 70 - DNA, 3501 bp, Pasteurella multocida
  CDS (298)..(1905): yabk
gaattcgaggaagggggcgtattacaaattgaaacggctgcacgtgtagcacaacatgataatgcctgtgcggatcatttccttgcctttttacttcatccagaagcacaagggcatttagtcaagaataatgtgatgttaccggtgattaataccaatattgaaccgcactttgatgcccttagagccacccaaatgaacacgaaagtgctcgatacctcaaaagtgaatgccgaacaagtcaaaaaatggattgctgtttggcaaacgaccctaacccaataattgtttgtcttgatgtttaagcgatttcgtgcattcacataccgtcccgccagttatcttggcgggatgttggtgattgtttttctgagcgctttttatgcgttcgccttaggggcggttttttcgctcccttttgcgcgcagttggacagcgttgttgagtgatcagtatttacaacacgtgatcatctttagcttttggcaagcctttctgtcggcggtacttgcggtcctctttggtggcattgtagcacgagcctttttttatcaaccgtttgtgggcaagaaactgatcctcaaattattttcactgacttttgtgttacctgccttagtggcgatttttggtttattaggcgtgtatggcgcttctggctggttagcgatgttaagccagtttttcgcttgggattggactcctaatatttacggcttaacaggtattttactggcgcatcttttttttaatgtcccattagcttgtcgcctgtttttacaaggtttgcaagcaattccggtgcaacaacgtcagctcgcggcacaactcaatttacgtggttggcattttatacgtctgattgagtggccctatttacgccagcaattgttacctgcatttactttgattttcatgctgtgttttaccagttttgcgattgtgctcactttaggtggcggaccgaaatataccacgttggaagtggctatctatcaagcgattttatttgagtttgatgtaccgaaagccggcttatttgcgttattacaatttgttttttgttttctgttattcacgctgagtagctttttttctccagcccccgccacgacattacacagtcaacctacttggtttgcgccccaatcgtattgggttaaattatggcaacgtatgatcattgtgtgtgcgacagtatttatcttattaccgctactcaatacgctagtttctgctttgctttcgtctcagttttttaccttgtggttacaacctcaattatggaaagcattaggttactcgctcaccatcgcccccacttctgcattgctcgctttagtactgtcttttgccttattattgcttgccagagaattacattggcgacattatcgcagcttatcccatgtgattttaaatatcggtgcgaccattttagccattccaacgttagtgttagctattggtttattcattttattacgtgagatcgatttttctccataccatctttttggggttgtggtatgctgtaacgcgttagctgctatgccttttgtgttgcgtattttggctttaccgatgcataacaatatgatttattatgaaaaattatgccaatcacttaacctgcgtggttggcaacgttttcgattgattgaatggcacaagcttcgtgcgccaatgaaatacgcctttgcactggcttgtgcgttatcattaggcgatttcaccgcaatcgcgttatttggtcaggctgacttcacatcgttaccgcatttgttgtatcaacaattggggcattatcgtagtcaggaagcggcagtaacagcgtttattttattggttttttgtttgagtgtttttatgattattgaacgacatcaggaaccgcgtgatgattaatttaaacggtgttcagttttcctataatacctttacttttgagctggatttgcagattcctgctcaacaaaaagttgctattattggcgccagtggcgcagggaagagtaccttattaaatttgattgcgggttttgcattgccacagcaaggggaaatttggttgaatggtgaaaatcatagccaaactcaaccttatgaacgtccggtatctattttgtttcaagaaaacaacttgtttacgcatttgactgtggcagagaatatggcattagggctgaaaccaagcctaaaactgaccgcacttgaacaacaacgcgtacaacaagtggcaagtgcagtgggtttgcagggttttcttaatcaattacccacccagttatcgggtgggcaaaaacagcgtgtggcgttggcgcgttgtttattacgcgataagccaattttgttattggatgaacctttttctgccttagatcccgatttacgggcagaaatgttgcatttattgttacagttgtgtgatgaaaaaaaattaacactcctgatcgtgacacatcaagtgaacgaattacagcagaaaatggatcgtatgattcgttttgaacatggtaggatgagtgagtccaccattttgaaggataattttaacgaaaaacagaccgcactttaggcggcttattaattagataaggaaagagaaaaatatgacaacggcaacggcatttgagattcgtacacttactcctcacccgaccttagaatattggtctgtgtgtaaaattgaagccctgtttgagaccccttttttagatttggtttatcgggctgcgcaagtgcaccgagaaaactttaatcctaaagccattcaattatccactttaatgtcgattaaaacggggggatgtccagaggattgtggctactgtccgcagtcagcacgttatcatactggagtagaaaagcagcaattactcgatgtggaagaaattgttgaaaaagccaaaattgccaaagcacgtggtgcagggcgcttttgtatgggggctgcatggcgtggaccgaaaccgaaagacattgaaaaagttaccgcaatcattaaagcggtgaaagaactgggcttagaaacctgtggtacctttggtttattgcaagatgggatggcagaagatttaaaagaagcgggtttggattattataaccataatctcgatacagccccagaacactacggtaatgtgattggtacccgtcaatttgatgatcgtattaatacgttaggtaaagtgcgtaaagctggcttaaaagtgtgctgtggcgggattattggcatgaatgaaacccgtaaagaaagagcaggattaattgctagcttagctaatttagacccgcaacccgaatcggtgccgattaatcaattagtgaaagtggaaggtacccctttagccgatgcggcagaattagactggacagaatttgtgcgcactattgcggtggcgcgtattaccatgccgaaaagctatgtacgtttatcagcagggcgtcaaggcatgtcggaagaaatgcaagccatgtgctttatggctggcgcgaatt

SEQ ID NO: 71 - protein, 536 aa, Pasteurella multocida
MFKRFRAFTYRPASYLGGMLVIVFLSAFYAFALGAVFSLPFARSWTALLSDQYLQHVIIFSFWQAFLSAVLAVLFGGIVARAFFYQPFVGKKLILKLFSLTFVLPALVAIFGLLGVYGASGWLAMLSQFFAWDWTPNIYGLTGILLAHLFFNVPLACRLFLQGLQAIPVQQRQLAAQLNLRGWHFIRLIEWPYLRQQLLPAFTLIFMLCFTSFAIVLTLGGGPKYTTLEVAIYQAILFEFDVPKAGLFALLQFVFCFLLFTLSSFFSPAPATTLHSQPTWFAPQSYWVKLWQRMIIVCATVFILLPLLNTLVSALLSSQFFTLWLQPQLWKALGYSLTIAPTSALLALVLSFALLLLARELHWRHYRSLSHVILNIGATILAIPTLVLAIGLFILLREIDFSPYHLFGVVVCCNALAAMPFVLRILALPMHNNMIYYEKLCQSLNLRGWQRFRLIEWHKLRAPMKYAFALACALSLGDFTAIALFGQADFTSLPHLLYQQLGHYRSQEAAVTAFILLVFCLSVFMIIERHQEPRDD

SEQ ID NO: 72 - DNA, 3182 bp, Pasteurella multocida
  misc_feature (452)..(452): n is a, c, g, or t
  CDS (1544)..(2809): ygiK
aactactaaggagttatgtatgaatattagaaaatcattactattaatatccctagcaagcttcatgtcactttcagtttcagctgcagaaattaatttgaaatttgaaagttcgaattttgcaggagaaaaagtttatgaaatccaaaaagaatggactgacaatattgaaaaagcttccaatgggagaataagtatagagttattacctctcgactcagtcttaaaatctagtgacatgctttctggtgttcgaaataaaattattgatggagcggttgcaacagcggcaatgtatgcaggcactgaccctggattcggattaattggtgatactatttctgcttggaaccatgacgaagatattttaaatttttactataatggaggtggttttgaagttgttgataatattttccaacaatatggtgccaaactcattggtgtatcanttacgggagcagaatcattaccatcgaaagtaaaaatagctaatactgaagattttaaaggtataaaaattcgggctccctctggtcctatccaaaaattgtttgcaagattaggagccgctcctgttggtcttcctggttcagaaatctatactagtttagaaaaaggtattattgatgctgccgatttctcaacgtttgcaaataatcaagcacaaggagtccatgatattgcaaaatatccaatctatccgggaattcattcttcaccagccgttcatatgattatgaatcataaaacttggagtagcttaactccatcggatcaagcattcttaattgcttactttaaagggatggctctcgatactctgactcgtgctcattatgaagataaactagcatataaagaagcacttgagaaaggagtacaaccagtttcttggaatcaacaagaaattacaaaagttcgttctatcgctaaagaaatttggcaagagatagctcaacaatctgaaataggtaatcaagtattatcaagtattaatgaaattcctagaatctcaaggaatgctgcaataatcgtcaagatggataagacgatatcgtcttatccattaaggagtaaaacatgcttatttctaaatatttattatggctctgtaataagctagatcaaatattcattaaagtaggttattacgtttcttatatttttctattagttgttatcattggttttacgaggttgttgctcggtatttattctctagcccaacactttgggttcatgaagtaacaacatttttaataagtctatcattactttatggtggagtagcttgttacgccagtaataaacatattgccatgacatttattagacaaaaattacctaataagatcaaatggttactagaactcttagttgaaatacttatttttatcttctttattttgcttagttacggagcatacttatcagctagagaagcattatttactccatcaggaaaattcaaaatgcaaacttctggaagtgtattagacatgccatttccagcaattgaaaaaagtttcttctttatttcatgcctcatcattgttgttctttcagtactacatatattccgtcacatctatacaaaatatcaggaggaattatcatgataagtgcatttgggataggtattggaactcttattatctttttaatgatgatttcccttttatttattggaatgccattaggttttctcactgggttaatcgctttagttatttcatatctttggtttgatactaccgcaataatgcaaatgatagcttcacgtgtcactgatttcacatcatcttacacttttgtagctgtgcctatgtttgttcttatggcaacattacttgataagactggaattgctagagatctctacaacgcaatgcgagtcattggcggtcgattacgaggtggaattgcaattcaatcgatgtttgttgcagttctacttgctacgatgtcaggtattatcggtggagaaactgttttattaggcatgttggcattaccacaaatgttacgcttaggctataataaaaacttagctataggaactgttgtagcaggaggagcattgggtacaatggttcctccaagtatcgtgttgattatttacggaatgaccgcaaatgtttctattggagaactatttcttgcagcaattccagcctccttactactttctacattctatattttatatattctagtactttgctacttcaaacctagctatggccctgcaatgcctagctcagaaaatcatacattaacgaaagaagatattaaaaaaattattcatgatattgcaattccagtagctatcgccacatggattttaggaagtatttatggcgggatagcatcaatcactgaatctgcctgtgttggtgtagttggggtaatattagcagcattctatcgaaaagaattaaatttcaaaatagtacaagaatcactaaaacatacaatcaatactgttggtatgataatctgggtcggcattggcgcaacaatgattataggtatttataatctaatgggtggggaccgatttatagctaacttattcgctagcttagatgcctctccaatttatactatcattattatgatggttattttattaatacttggtatgttcttagattggattggtgttgccatgttgactttcctcaagacaagtaaagcgacaatcaatttgtgttttgacatagtcaggtacagtatttggcgtggtccctccttccacagtaccaatgttcatcgtggtacctttgtcgggcgcggtactttttagtaaatcttgcgcgatacgaataaacgcattgatggcatttgctccgttttgtggatcgactgccgcatgagcagatttgccaaaaaattcaattacatacttcccaatcccttttctttcgttaacgtttccacttagattgcccagaagccgatctgtctgaatgggaacaagtgttataccaagaagcgaatccaacaggtgaagtggtgatcggtatggtgggtaaatacactgaattaccggatgcctacaaatcggttaatgaagccttgaaacacgcaggcttaaaaaaccgtcttagcgtgcaaatcaaatatattgattcacaagatgtggaaaccaaaggcacagaagtgttagaaggcgt

SEQ ID NO: 73 - protein, 422 aa, Pasteurella multocida
MPHHCCSFSTTYIPSHLYKISGGIIMISAFGIGIGTLIIFLMMISLLFIGMPLGFLTGLIALVISYLWFDTTAIMQMIASRVTDFTSSYTFVAVPMFVLMATLLDKTGIARDLYNAMRVIGGRLRGGIAIQSMFVAVLLATMSGIIGGETVLLGMLALPQMLRLGYNKNLAIGTVVAGGALGTMVPPSIVLIIYGMTANVSIGELFLAAIPASLLLSTFYILYILVLCYFKPSYGPAMPSSENHTLTKEDIKKIIHDIAIPVAIATWILGSIYGGIASITESACVGVVGVILAAFYRKELNFKIVQESLKHTINTVGMIIWVGIGATMIIGIYNLMGGDRFIANLFASLDASPIYTIIIMMVILLILGMFLDWIGVAMLTFLKTSKATINLCFDIVRYSIWRGPSFHSTNVHRGTFVGRGTF

SEQ ID NO: 74 - DNA, 2787 bp, Pasteurella multocida
  CDS (463)..(936): yhcJ
gttaacacaccatgattaatgatgccggttgaagccactgcaacgtaatcgaattgtccggcatacaaagcaagaatgttggccagtgtgtcatgcatcgcattggcagcatcagcttgtggcgttgcaatctgttggcgttgttctattttgccgtctgttacaatagccgaggcaatttttgttccaccaatatctaatgctaaacagcgcataggctctccttctgtgatgacttattttgccgatttgacggcatcggcaaaccagcttacgatatgttcgaggcgagtcagcgcagatcctacggtgacagagtaagcaccaatctcaattgcggttttcgccaattctggggtgttatagcgcccttctgccatcactcggcagccagcagcattcaaatctttgactaactgataatccggttcagctggaatttcaccgccagtataaccagacatggtgctaccaataatttctacccctaagttgtggcaatacatcccttcttcaaaattagaacaatccgccatggctaaacaacctaattctttgattcgtttaataatggcttcacgtgtagttggacggacgcgatcggtaccatcaaaagcaataatatcggcgcctgctgcggctaactcttcaatgtcttgtaaaaatgggctaatacgaacgggactgtcaggtaaatcgcgtttaacgataccaataatcggtacattgacgacgttacgcgtggcttttaaattttcgatcccttcaatacgtaacccggcagcaccaccgataacggatgcttgcgccatggcggcaacaatttctggcgagtccattggcccattatctacgggctggcaagatgcgattaagccatatttaatttgttctaaaacttgcggatgtgatagttttgacatattaactccagtctaaatttatcaaaagaagattgactccaatttgcataggttaatcttagaattaaaaaataacaaccaaaataataaaaatttgagatctttgtcgcatatttattcatagggaatagacagcttaattttagttatgatttgtcaatccttgctattttttgtgtttgctggtttgcgatacactgttctaatattgctttgagcacttgataaccttgctcattaaaatgtaatccgtcggtacaaaggcgtaaatccagttcaccgttagaatcacaaaagtatttttgtgtttcaacgtaagtcacgtctgacggacaatgttgttttaaataggtattgagcctgtgaatttgtgcgttagtgaccgtattaatctgattgaccggtgtggcttctaataaaaagtagtgggacgtaggagaaatggtgtgtaggtgagtcagaatgtcatttaactatcgcatgacttgcgccggtgaatacgtttcttccttacaaatatcattgacgcctaaaaaaagaaaaacagattgtccaagttgttgaatccgtttaggtttaacgataacatccaaatattgtcgcgtactgacgccagaaagtcctaaattggcgacggtttgtcccgctaattgaggtgtgcctgctacctgttcgtcccacatgtcaaaaagtgaatgaccaattaagctgatattggcaggtttggaaaattccgccattttgctctgatagcgttgataaatatcctgatcacttagcatgtgtggacctctattttgaaataaaacgctaagtattatataaaacctgatatgccggtaaacagtaaacttatcttccgtaggggtaaatattcaattttgtgacgaacctatcatttatgaaataaaacttcattttctatataaaaaatagttttttcactttagaatgccaaacgtgtgaaatttatttcatcatcattttaacgtaatcccaacgtaaccaatagaggagaactcataatgaaatttaaaaaactactacttgcatctttatgtttaggtgtttcagcttctgtatttgcagcagattacgatcttaaattcggtatggttgcgggtccaagctcaaacgaatataaagcagtagaattctttgcgaaagaagtgaaagaaaaatccaatggcaaaattgatgtggctattttccctagctcacagttaggtgatgaccgtgtgatgattaaacaattaaaagacggtgcattagactttacgttaggtgaatcagcacgtttccaaatttacttcccagaagcagaagtatttgcgttgccttatatgattcctaattttgaaacctctaaaaaagcgttgctcgacacaaaatttggtcaaggtttattgaaaaaaattgataaagagttaaacgtacaagtgttatctgtggcgtataacggtacacgtcaaacaacttctaaccgtgcaatcaacagcattgaagacatgaaagggttaaaattacgtgtacctaacgcggcaaccaaccttgcttatgcaaaatacgtgggtgcagcgccaacaccaatggcattctctgaagtttaccttgcgcttcaaacaaactctgtggatggtcaagaaaacccattaccgacaatccaagcacaaaaattctatgaagtacaaaaatacttagcgttaactaaccacatcttaaatgaccaactttacttaatcagtaacgatacgttggcagatttaccagaagatttacaaaaagtggttaaagatgcagcagcgaaagccgctgaatatcacactaaactcttcgttgacggtgagaacagcttagttgaatt

SEQ ID NO: 75 - protein, 158 aa, Pasteurella multocida
MVLPIISTPKLWQYIPSSKLEQSAMAKQPNSLIRLIMASRVVGRTRSVPSKAIISAPAAANSSMSCKNGLIRTGLSGKSRLTIPIIGTLTTLRVAFKFSIPSIRNPAAPPITDACAMAATISGESIGPLSTGWQDAIKPYLICSKTCGCDSFDILTPV

SEQ ID NO: 76 - DNA, 2787 bp, Pasteurella multocida; identical to SEQ ID NO: 74
  CDS (1949)..(2785): yiaO

SEQ ID NO: 77 - protein, 279 aa, Pasteurella multocida
MKFKKLLLASLCLGVSASVFAADYDLKFGMVAGPSSNEYKAVEFFAKEVKEKSNGKIDVAIFPSSQLGDDRVMIKQLKDGALDFTLGESARFQIYFPEAEVFALPYMIPNFETSKKALLDTKFGQGLLKKIDKELNVQVLSVAYNGTRQTTSNRAINSIEDMKGLKLRVPNAATNLAYAKYVGAAPTPMAFSEVYLALQTNSVDGQENPLPTIQAQKFYEVQKYLALTNHILNDQLYLISNDTLADLPEDLQKVVKDAAAKAAEYHTKLFVDGENSLVE

SEQ ID NO: 78 - DNA, 2590 bp, Pasteurella multocida
  CDS (908)..(1294): yigF
ctgcaggctcgattagtggggcaccgaaagaaaaaaccgtgcaaattattcacgccgcagaacagcagccacgcggttattacacggggatttttggtctgttcgatggtgagtcgttacaaagtgcggtggcaattcgttttattgagcaagtggacgagaaattgattttccgcagcggtggcgggattacgatcttaagcgagctagaagacgagtaccaagaattgatccaaaaagtgtatgtaccagtaggataagcgatgacatttcctttatttgagacgatcgctattgtgaacggtgaaattcagcaccttgccctgcatcaacaacgttatgcggcaagtttggcgaccttttacggcgagaaaggagcgaaagtacaggatcttgcgaaaattattcagattccgaccgcacttgaacacactcaacatgcgccgataatccgttgtcggattgattacaatcagcaagactgtgacgtgcattattttccctatcaacgcaaaatttaccgcacttttcagcctgtcatttgcgatgaaattaactatgatctgaaatatgctgatcgggcattattaaatcagttatttgctcagcgtagggattgtgatgagattatgattatcaaacacggcaaggtgacggattgcagtattggtaatctggtgtttcgccaaggtgagcaatggttcacgccagatagcccgttattttacggcacacaacgagcctggttattacaacaaggcaaaattcaagcccgttccatcttattgcaagagatcgcacaatttgaagaaattcggttaattaatgcactaaatccgctgtaaattttccttgaacagcgtaaaataaaacaactttttcagtcagataaaaggagataaacgacatgacgaaagtaattcatactgacaatgcaccagccgccattggtccttatgtacaagcggtagatttaggtaatatgctgttaacctctgggcaaattccagtgaatccaaaaaccggtgaagtgccagcggatatcgtagcacaagcacgtcaatcgttagaaaacgtgaaagcgattgtggaacaagcgggattacaagtcgcaaatatcgtgaaaaccacggtgtttgtgaaagatttaaatgactttgcagcggtcaatgcggagtatgaacgtttctttaaagagaacaatcaccctagcttccctgctcgttcatgtgtggaagtggcacgtttgccgaaagatgtggggattgaaatcgaggcaatcgctgtaaaagcctaatgaatagcttgcatttatcttagtcgtagcaaaacaatctcttttcacttgctctcttcaaagcaagttgataagtgatttttattgggcgtttttctattgatagccaaaaacgccctttactgatagagaataaactatgcaaaatcaagtcatcgagattctacaataccgtttaaaaccacaatcaggacaaacgtttcaccaaattatgcgtgagatcagtgttccactccataaacaacatgggattgatgtcattgcgtatggaaattcattacatgatattgacagctattatttaatccgtgcatttgagacagaaaccaaattgcaacagcagctcgatgctttttatgccagtgatgattggcgtgatggaccaagagaaagtatcattcgcctgattgaaagcagtttaaaatcggtgatcatgctcccgacacaggcaatccatgcactacgcaaccattatcctcaataaaatcaacaaccgcacccaatcagtgcggtcattttttcttactttttcagtgctaagggaaaaacaacgatagtggacgttgtttaatcaatttccaaacacattgcgcgatatcacaccaactctcaatttctgtttctaaagaacgcagcgcaacccataacgcgataaagaaactgacaatcaaattcaccataccaatcaataacacgaacactaaaccttgtaagaacatctgccaagtaaacgcgccactgatcgccatatagcccaaattcgcagaagaaaacgccacatggcgaatatctaacggtaaattaagcaaatacccgactaaccccgttaaaccaagcaataaaccaaaacacagatttcccataatcgaaccgtaattatcatgccagtattctgcaaatttgtagcgcatattacgggtcaacagacggcgtaaaatagggtgatttcttagtcgcatttttaagttcaaataattactacgattatcaaaataaccagaaataatcccagaaaagaataaccagaaacccgcaatggcggcaaaccataaggaccctttcatcggatcaagggatttttgttggtaggcaatctccgcgtcactcaataaaggtgtaccaacataatgttgatagcctagcgcaagcaaacaagccacagaaatcgctaaagtgacattacccaagactgccactgtttgcgagcgaaacacatcgatcagcagttgagctaattgcagattaacggatttgccttgtccattatccaccgtttctgcaaaacgtgctgca

SEQ ID NO: 79 - protein, 129 aa, Pasteurella multocida
MTKVIHTDNAPAAIGPYVQAVDLGNMLLTSGQIPVNPKTGEVPADIVAQARQSLENVKAIVEQAGLQVANIVKTTVFVKDLNDFAAVNAEYERFFKENNHPSFPARSCVEVARLPKDVGIEIEAIAVKA

SEQ ID NO: 80 - DNA, 6642 bp, Pasteurella multocida
  CDS (463)..(1884): yleA
aacccagctcagataagtttaattctggctatggaaagtggaccaaatccttcgatctcccaggtttctaaggcgcgatacgggcaaatacgagtattttcgatatactgccaagcacctagttgttttaagagattaacggaagcaacactgatcgcagaaatgcgaagatcgtaaggcgaattaggttgaaactgtgggagtggggcgtgttcgataagctggacttgatgtccttgtttacgtaagccaagcgcacaggctgcaccaaccatgccaccgccaaccacgatcatgtctttttgtatgacgtccataggattttccttttctttttgttacgtattctaccgtcaatgagggaatttcaaaagaaatctcttttttagctagccagcataggttcaagactgtaaaatagtcagtcacatttttataggttaactgaattttttaaacgatatgacgcaaaaattacatattaaaacgtggggttgtcagatgaatgaatatgattcatctaaaatggcagatctcttaaacagtactcacggcttagagttaacagaaattccggaagaagcggatgtgttattgttaaacacttgctcaattcgtgaaaaagcacaagaaaaagttttccatcaattaggacgttggaaagaattaaagaaacataagccgggactcgttatcggtgttgggggctgtgttgcctcacaagaaggagaacacattcgtactcgtgctccttatgtcgatattatttttggaccacaaaccttacatcgtttacctgaaatgatcaatcagatcagaggtggtaaaagctcagtagtcgatgtcagttttccagaaattgaaaaattcgaccgtttaccagaaccgcgtgcagaaggtccaactgctttcgtatccattatggaaggctgtaataaatattgctcattctgtgtcgtgccttatacgcgtggtgaagaagtcagtcgtccagtggatgatgtattatttgaaattgcacagttggcagagcaaggcgtgcgtgaagtgaatttattaggacaaaacgtgaacgcttatcgtggtgcaactcatgatgacggtatttgtacttttgcggaattgttacgtttagtagccgctattgatggtattgaccgtttacgttttaccaccagtcacccaattgagttcactgatgacattattgatgtgtaccgtgatacgccagagttggtgagtttcttacacttacctgtacaaagtggttctgatcgtgtgttatctatgatgaaacgcaatcatacggcattagaatataaatcgattattcggaagttaagagcggtgcgtccagagattcaaattagctcagattttattgtcggtttcccgggcgaaacagcagaagatttcgagcaaaccatgaatttaattgcacaagtaaattttgatatgagtttcagcttcatttattcagcacgtccaggcacgccagcagcagatatgcctgatgatgtgacagaagaagagaagaaacaacgtttatatgtgttgcaacaacgcattaacaatcaagccgcgcaatttagtcgagcaatgttaggcacagaacagcgcgtgttagtggaaggaccctcgaaaaaagatttaatggaactcacagggcgtacagaaactaatcgtatcgtcaattttgtgggcacgcctgatatgattgggaagtttgttgatatcaagatcacggatgtgtttactaactcactgcgtggtgaagtcgttagaactgaagaacaaatgggacttcgcgttgttcaatcgccacaaatggtgattaatcgtactcgtaaagaagatgaactcggcgtgggacgttatcacgcgtagtcgtgctatcccttcaaatatttaaccgctctcgagtttctcaagagcggttattttttatgaaaaatttttgataaattgaccgctctttttattgcttcattttatgatagacagcgtgttttctgttattcatcgtatttctttttatttcacttcattaataaattattaaatttcaattgcttatcaaaattgttgttttttgctttttttctatttatagcatggttattttttatacacacatggcgtatttctccatatttttacaaaaaactgtgacttcactctaactattgttctctcgtgctttactccattttataaggcggttagtttagatcatgttgtttttacaacatattttgaggttgtttgaaggttgagcttattttatagttgaggtgatgatgaaaaaatttaatcctagtatattggcgttgtccatatcaagtctgctactcacatccacattgacctttggtcaaatccagcaacaagataaagcactctttggtgtgaaagaacatcaagaaagcctactctttcatcagagcttagtagaacaaggtagtgataatgtgccaatttggcgcattccgtctttattaagaacaaaagacggtgtattaattgccgccgcagataagcgttggcaacaccgtggtgactggggcgatattgataccgcaatccgaattagtcatgatgatgggaaaacatggggaaatattacaacgattttggatttgccatcaaagaatggggaaaaatccccatcagcaccagatcctgtaacattcaacgcgtggggagatagacaaaattgtacaacttactgtaattctgcttttttgatcgatgctcagatggtacaagataaacgtaatggtagaatttttttagcagttgatatgtttgccgatggagcaggtttttttggtgtaaaagacagtggtaatgggcgcattaatattgatggtaaacagtatcctattttaaatgaaaagcaatcgggtcgacattgaaccctgtgttcttaactctttcacttgctcaacgttcaccggaatcacgcggtcaataaaagtcggtttccagtttaaacccggttgaacaatagcgtgtaattcaccaaaacgcatcaccacgccacgttctgcttctttgacagtataaaaaccgctaacgccccagacaattgcaccaatcaccgctgcaattggcaataatttaccaagatttaacgatccaccagaatgcgagttattgcgtttaccgccattccctgaaccgcctaattttttcagcagattattaaaaatctcttcaatatcaggtggtgattgctcttgattgttttgcttacgacctgactggttatcattccaattcggctgaccgccttcattatcaggacgctgactctcaggttttttctgtccgggtttgccccaaggatcttgatctgaaccgttcaatgacattacgttctccatttgtcaaaaaattgttacttgtttaaacaaattcccacagtctaaacaaaatgttggattaagtctaacgaaactcgttactaaatggggatattttttatgatttaaagtgccgccaataaaaacgcacaatggtctcatttttacggcttactacctgacttttgtcctatcgctttgtcggtcatgttttttcattcaccttataataaatggcgtcgtgtaaggtggtttccgctaatattcccctctgccaagtaaaatagtgcacatctaagcactgtgtttggttaataaaaaaagccaagtaaaacggcaagcggtgactaaagaggagttaactaagtttctgtatgctagcgtactattgactcttcttgcactgtgtttgggttttattgcggtgaatgaaaccctagcgtgtatttctttgttattgttggcttatttaagcgttagccgagtattatttgcgctcgcgttgttgggcgtgatcatgaatttgagctattactattatctcttgagtatccctttattacataaatctttcttactcatgggagtaggcatcgttctggcactagttacgtttgttttatcacgttataacaaggcaccgcaggcaacattacaagctgaatcgcacaatacgtttcaaccacaaacaatgttacgtaaaaaactaggattcactttgttggcgacatgtttgattgcctttgccacgaattatactattcataaatatgaagatattttaacgaatggtgagtcaattattttaaaaacggcacccgttgatccgcgttccttgatgcaaggggattatatgacgttgaactatgaaatcttggcagacattagtgaggaatggggaaaaaatttagaagaggaaaaaacacagtattttgtttatgcgttgttaaaacgagacagcctagggattgctaccttgtgtcgtcttgaaaccaaagcacctacaacatttgacgggtgtacaccaaatatttacttaccggtgaatgtcgcgatgtggtggccgcgtttaccaagtcaagactacttttttgccgagggaaaaggtgaatattatgcacaagctgaatatgccgaatatcgctttaaagggggaaaagcgttgttgttccgcttactagataaaaatttaaaagcattataaaacaaaaggcggtagtgaaccgcctttatgttgtatgccacttacttcaccgcaatcattgagccaaaattaaagcattgaaaccataattccacttgttgaaaaccgacttcagctaaacgcattttatgggcttgaatgctgtctgtacgcatcacattttcaagtgcggtgcgtttttggctgacttcaagttcactgtatccattcgcgcgtttaaattgatgatgtaaatcaatcaacaaggcattcatgttttgatcttcaaaatgaaatttctcggatagtaccaagatcccattcggttgtaagccttggtaaatcttacttaataaggctcgacgatcttcaggtggcagaaattgcaaagtgaaatttaaaattaccatgaaggcattttcgatttcgatatggcgtatatcatcacaaataatgtccacaggtattgtactttgataggcactaacatgctggcgacaacgatcgaccatgggttgtgagttatcaacaccaatgatcttgacgccgggttgattaatatgacgacgtgcagataatgttgccgcaccgcgcgagcaccccagatcatagacgttgctattcgccgtaacaaagcgtgatgccaacatcccaatagcggtaatgatgttggcatagccgggaatagagcgttggatcatgtcgggaaagacttcagctacgctttcatcaaaagtaaaatcccccaatttagcaatggggagtcgaaaatagagtatcttttgtcataatgtattaaagaccgagaaaaagtgcggtcattttagaagaagtttcgacctatcacaaataaattatgatttcgggaataaatgcgccatggcactttcttcttgtttaatacgcacgcctaggataagcaaataaatgggtaatccaatcaatgcggtatattttgcttggcagaaaagcgataaaccaattaactcgggaataatgtttaagaaataattcgggtgacgtacgtatttaaacaagaaagagcggttaatgtgatgttccggtaaaatgtaaagttttactgtccaaatctctttcagttcataaatcacgtaaaatagcatggcgatcgcaaagactaaaatcgccagccctatttgtgaggtgctattaaatgctgtgttttggttattagcttcaatgatcgcggcgagataaaatacaacatgggcaatggataacagcgtagaattgcgtttaccatattgtattgcaccttttgcaatcaatgctttttcatggcggattgaaatagacagactataaaaacggatcgctaaaatacaggcaaaagtgatattgataaataacatgtggttatccttaacataattttattccaataaagtggcgtaatataacaaaaaatccgatgatatggcatggaaatacgcctttattttgaacgttcatcgcttttctttttctttattggttgatttgtaagcataaataacctttttatctctcttggttttccgctataattgagtgaatttttgagcataattaagagtacaaaggattttgaaatgatgcgtacacattattgcggtgcattaaaccgtgacaatatcggacaagaagtaacattgagtggttgggtgcatcgtcgccgtgatttaggtgggttaatttttattgatatgcgtgatcgtgaagggattgtacaagtgtgtttcgatccaatatatcaagaagcactcaccacagcagcaagtttacgtaatgagttttgtattcaaattaaaggcgaagtgattgcccgcccagataatcaaatcaacaaaaatatggcaacaggcgaagtggaagtgttagcaaaatccctgtctatttataacagcgcagagccattacctctcgactttaaccaaaataatacggaagaacagcgtttaaaataccgttatttagacttacgtcgcccagaaatggcgcaacgtttaaaaacacgagccaaaattaccagctttgtgcgtcgctttatggacgaacatggtttcttagatattgaaacaccgatgttga

SEQ ID NO: 81 - protein, 474 aa, Pasteurella multocida
MTQKLHIKTWGCQMNEYDSSKMADLLNSTHGLELTEIPEEADVLLLNTCSIREKAQEKVFHQLGRWKELKKHKPGLVIGVGGCVASQEGEHIRTRAPYVDIIFGPQTLHRLPEMINQIRGGKSSVVDVSFPEIEKFDRLPEPRAEGPTAFVSIMEGCNKYCSFCVVPYTRGEEVSRPVDDVLFEIAQLAEQGVREVNLLGQNVNAYRGATHDDGICTFAELLRLVAAIDGIDRLRFTTSHPIEFTDDIIDVYRDTPELVSFLHLPVQSGSDRVLSMMKRNHTALEYKSIIRKLRAVRPEIQISSDFIVGFPGETAEDFEQTMNLIAQVNFDMSFSFIYSARPGTPAADMPDDVTEEEKKQRLYVLQQRINNQAAQFSRAMLGTEQRVLVEGPSKKDLMELTGRTETNRIVNFVGTPDMIGKFVDIKITDVFTNSLRGEVVRTEEQMGLRVVQSPQMVINRTRKEDELGVGRYHA

SEQ ID NO: 82 - DNA, 4835 bp, Pasteurella multocida
  CDS (407)..(1156): yojB
gtcaacgacggggcgggtcttagaacattggcatacgggtacgatgacacgccgtgtcccagagctccatcgctccttcccaaataacttggtttggatgcacccattagatgcgaaaaaacgtggtttacgtcatggcgataaagtgaagatcagctcacgtcgtggcgaaatgatttctcacttagatacccgtggacgtaataaagtcccacaaggcttagtttacaccactttctttgatgcaggtcagttagcaaactatctcactttagatgcgacagacccaatttcaaaagaaacggacttcaaaaaatgtgcggtcaaagtggaaaaagcgtaacacgttaaatttaatgaggaacgaccgcactttgctttcagtaaagtgcggttggaaagtcgaatgaaaaaaacagttgtgaatcctgaacgtcgtcgattttttaaagaggctacgcgcactgcaggcgggttggcaggggtgactttgctccttggtttgcaacaaaagcagagtcttgcgcgcgaaggcgtggcgttacgcccaccttttgcccttgagaatgagaaagcgttttctgctgcgtgcattcgttgtggtcagtgtgtacaagcctgtccacatgagatgttgcatcttgcctcactgatttcaccgatggaagcaggtacaccgtatttcattgcgcgcgataagccctgtgaaatgtgtgtggatattccttgtgcaaaagcctgcccaaccggtgcattggataatcaagcaacagaaatcgatgatgcgcgtatggggttagctgtcctgctagatcatgaaacttgtctgaactggcaaggtttacgctgtgatgtgtgttatcgcgtctgtccgctgattaataaagcgattacgttagtgatgcatcgtaatgagcgtacgggtaagcacgccgtctttatcccaacagtgcattccgaagcctgtacaggatgtggcaaatgtgaagaagcttgcgttctagaagaagcggcaatcaaagtgttaccgatggcattagcgaaaggcatgttaggtaaacattaccgtttaggttgggaagagaaagaaaaagccgggcattcccttgcgccagaaggcattatttctctcccgactcggttaccggagagcttgtaatggcaaattcaccaaaatatgcgggtaaagaagcacgagaaaagttaggctggtggtacgccaatcgctttttgttctggcgacgtttaacccagctgagtattcttgccatgtttttaagcggaccttattttggggtgtggatcttgaaaggcaattacagtagtagtcttttgcttgatttgatcccgatgactgatcctttgattatggcagaaagtctcgcgaccggttttatgcctaccatgaccgcgttgttgggtgccctgattgtggtggtgctttatgccattttagggagtcgcgttttctgtgcttgggtttgtccgttaaacatcgtgacagatgcgtccgcttggctcagacgtaaattagaaattcgtcaatcggcaaaactcccacgaagtttacgctatgcgatcttagtgatgattttgttaggcagtgcgctaagcgggttattactttgggaatggctcaatccggttgcagcactaggtcgtgcgttaatttacggtttcggtgcgacagtttggcttgttcttgcggtgtttttatttgatttatttattgtcgagcatggttggtgtgggcatttatgcccaataggtgcagcctatggtgtgattggtgcgaaaggactttttcgtatcaaagttgagcatcgccaacaatgtgataattgcatggattgctataacgtctgtccagaaccacaagtgttacgcgatccattacatgcaaaaaagagtgaaagcccacttgtgctttcaaaagattgtatcagctgtggacgttgtatcgacgtttgccctgaaaaagtatttatttttacaacacgatttaatcattcagttaatcattcgggggagtgatcaaaatgaaaaaaacaatgctaattttgaccgcactttttgccttcacggtcaatgccaatgaagtcaaagtgggcaaaagtttacaagattcacctgaaaatatcgcgccagccttccacaatacaccaaaagaaagtggcttggcgccgttaaactatgtgaaccaaccaccgatggtgccacacgcgacgaaaaactatcaggtgacgaaaaatatcaaccaatgtttaacttgtcatagcccagaagcctcacgtgttactggtgcaacacgcatcagtccaacccactttatggatcgtgatggtaacattgtcggaggcacctcacctcgccgttacttctgtttacaatgccatgtctctcaatctgatgttgagccgattattcaaaatgaatttaaaccgatggctggttttggtaaataagttaaggacggaactatgttgaacttaattaaacgcttttggaaatggtttcgctcgcccagtcgtattgccgttggtaccttgattacccttgcttttattgcaggtattgtctcttgggttgggtttaattatggcttagagcaaaccaatacagaggaattctgtgttagttgtcacagtaatgatgtgtatccagaatatttacatacggcgcattatttaaatcgcagtggagtaaaagccacttgtcctgattgccatgtaccgcacgaatttattccaaaaatgatccgtaaagtccaagccagtcgagaagtgtatgcgcatcttatgggttatacggataccattgataaatttaactcccgtcgtttgcatatggcagaacgtgaatgggcacgattaaaagccaataactcgcaggaatgccgtaactgccataactttgagaatatggattttagtcagcaaaaaacggtggcggaaaaaatgcatgcacttgctataaaagaagaaaaaacctgtattgactgtcacaaagggattgcgcaccaattaccggatatgagcggtgttgagtcgggttttagtacggaacaaaaataacacttttcttgttctcccacaggaaatctgcatcgtattcaggtgcagatttttttatttttacgatcatcctcacaaccttttcgctgataaataggatacaacgctagctacacgctatcttgctgctttttgtgttgttgtgagggattatgtcatcttatctgcctcttttattacgtttgttacaaattccgcgtttgggttcgctggcgatccagcgtttattggagcacatcagtccagcggaattaatggaatatgatacaaaagcctttcaacagataggctggacggcacagcagattcagcgttggtttacgcctgagaaccgttatattgatcccgcgttagcctgggtaaacgaacaacaacatattgtggattggtttgatcctcattatcctcccttgttaaagcaaacagaagaggcaccacttgtcttgtttgtgaaaggggaagtggctacgctatctgcacagcaagtggcgatcgtgggcagtcgtcattgttcacgttatggggaatactgggcaaattatttcgccactcaactggcttatgccgatattgtggtgaccagtggtttagcgttaggtattgatggtttctcacatcaagcggtagtggatatccacgggaagacgattgcagtattaggcagtggtttagaggtcatttatccgaaaaaacaccgaggtttagccgaaaaaattattgaacatcaaggtgcgttagtgtctgaatttttacctttccaaccccctgtggcagaaaattttccacgtcgtaatcgcattattagtggtttatctttggggacattagtcattgaagcctcagaaaacagtggttctttaattactgcccgctatgctttagagcaaaatcgagatgtttttgcgttaccggggcagattcagcatggatttagccaaggttgtcataaactgattaaacagggggcaatattagtcgaaagtattcaggatattttagaacatctctcgccttattcgcattgtgccatgccagcgttgcctcgtacggagaacgccttttctcaacaagtaacagacacatcaaccatcaatactgcgcggataacgccagaacatccggaattatatgccaaaattggctatatgcccgtcagtattgatgtattagcccaacaagtcaatctacctattgataccttattagtacagcttttaaccttggaattgcaagacttgattgttgctgaaaatggattatatcagcgcaaataacggaaagagtaaccacaaatgagaaaggactgtgttgaaacggctatcaacatcagtccttgcagtatattatctcatatgacacgagacggcagtttcatgagattaatagagactaaacgcttgtaaatacggtagtttgcctcgttgtagcattttctcaatattgcctttgtgatcatcacgacctaagcctcgtagctcaatattgataccaatacttttgtcataaaaaatttgattcgccgtttggttttctttgctggtcacactacgtcgggcaccaacattaatcgcccaacagcaagtgctgtattctagtcccaaatattgctcaacaggctttctcaacgcaagatcttgataatgacgtgctaccaccgcccattgatccgtgagtgcccatgccacagttagaccaagctgttttatgtcttgtccgtagcggttcgccgctgaggtgaggttttggtcaatatattgttga

SEQ ID NO: 83 - protein, 250 aa, Pasteurella multocida
MKKTVVNPERRRFFKEATRTAGGLAGVTLLLGLQQKQSLAREGVALRPPFALENEKAFSAACIRCGQCVQACPHEMLHLASLISPMEAGTPYFIARDKPCEMCVDIPCAKACPTGALDNQATEIDDARMGLAVLLDHETCLNWQGLRCDVCYRVCPLINKAITLVMHRNERTGKHAVFIPTVHSEACTGCGKCEEACVLEEAAIKVLPMALAKGMLGKHYRLGWEEKEKAGHSLAPEGIISLPTRLPESL

SEQ ID NO: 84 - DNA, 3494 bp, Pasteurella multocida
  CDS (2411)..(2719): yyaM
gtcaacgatccgaatacgacggaagaaaactatatgcaagtcatttatggcaagactgcgcgtctattcgaagctgcgacgcattgcgccgcgatacttgctcatgcgacggaagcccaagaaaatgctttacgcgaatatggttgttatctaggcacagcttttcaattagtcgatgatattttagattatagtgcagatgcaaaagcactcggcaaaaatattggtgatgatttagcggaaggtaaaccaacattaccgttattacacgccatgcatcacggcaatccagcacaagcaaaattgattcgcgaagcgattgagcaagggggtaagcgtgatattttagaggatgtactgacaattatgacagaacataaatccctcgactatgcgatgatgcgcgctaaacaagaagcacaaaaagccgttgatgcgattgcattattgcctgaaaatgaatataaacaagcgttaatttcattagcttacttatccgtcgatcgcgcttattaaccacttaataaggcgagacatgttagcgtaacgaccgcctaaagtgcggtcatttatttagtaattttaaacacgacaatgacagaacaaaacatccctacgaaaaaaacacgcaaaggcaaagatcctcacgcgccttttgtacgcgaaaaattatccctaccaaatgggcataacaaattgttattgcattcttgttgtgcgccttgctcgggagaagtaatggaggcaattcatgcttcaggtattgaatttactatttacttctacaacccaaacattcacccattaaaagaatatctcattcgtaaagaagaaaatattcgttttgcggaaaaatggggcattccgtttattgatgccgattatgatcgtcaagaatggtttgaccgtgccaaaggcatggaagatgagccagagcgtggtattcgttgcactatgtgctttgatatgcgttttgaaaaagccgcagaatatgcacacaacaatggtttccccgtatttactagctgcttaggtatttcacgttggaaagacatgaaccaaatcaacggttgtggacaccgtgccgccgaaaaatatgatgatgtagtgtattgggattataactggcgtaaaggtggtggctcacaacgtatgattgaaatcagtaagcgtgaacgtttttaccagcaagaatattgcggttgtgtgtattctttgcgtgacacgaataaatggcgtgaagcaaacggacgccaaaaaattgaaattggcaaattgtattattccgccgattaaaacaaccaagtaaaccatcgtgccgtcatataacatggcggcacttttttaggctttatatatgcaacgttttcgccaatctttcgaaacctaatgctaacgcctcttcactaatatttaatgctggggcaaaacgcaatacattaggacccgccactaaaatcattaagccattatctgctgcttttttgacaaattcgctcgctcttccgtgatattgctcgataagttctgcaccaattaacaaaccttcgccacggatttctttaaataagccacattgctgattaatttcttgcagcttttgcataaatttttcagaagtgcgctgaattttttgcaagaatggtggtgctgaaatgatatcaatcactttttctgccacggcacaagcgagaggattgccaccaaaggtggtgccatgcacgccaggtgcaaaacttttggcgatctcatgcgttgtcaacgaatgagaaaattgtgacagattgggctccaacgggacgtgcggatgagattggggatacgcaagtacgttatgaaattgagcaggtgagttctagcaattatagtgcactgtttgtctccattttacagatgaaacgtaatgaggtggtatttagtccacatttagcggataaacaacgttatagttctgatcgcttgaaccaacttgttggtgaattagatgcgtcttatcgtaaacaagtccgtgatttgaataacagcggattgatgccaattcagtctgtattcggtacggacagtaatgggcgtactgctctcgtgttaggcgcaccctttaatcatgcgtggacaaaactaggacaagttttaccgcagcttgaatttgatattaaagatgaaattattggtcgtggggtaagggagttaaaataccgtccagctggagcaaaaagttggtggtggccatttggtcgtgctgaaggcagtagcggactgaaaacaggtacctattttatgcagttaagcgccttagggaagcaaagtgcggtggtgatgaccgatgatgatggcaatgcgttatctggggagcaagctcaggcgctttatcaagcattacaaaatctcttagcgaaataatacagtcaagatgactaaactcagtatccagcgagataacttgatttgtttgagttatgtcgcattaatgggattcggctttcccattatgcgttatatgagtattcattttgatacattaaataataacgctgttcgctttctctcagggggcagcgtttttattttagcctgttttttttattatcgcgctgagttaacatcttcgggggctggcgtccagtccgttgcgatgttgccgagttcaagtttaggtttcttaatattgaaaactgtaccatctttttcatacgttacaatctcaacacttaatcgcgtttgaccttccgatttttgatagtcaaagactactgagtaacgcttgtagtcgcgtgaatcgactgttacataagccgatatgtcagaataagtactgccggtatatcgtcttaatctaagattaagcttgccacttttgttcgataaagcgtcaaacgaaagcacgactttaccgtccttgacttccacctgatcttcaatgagcacttgacttagtgcgaccaatcgaccgttggcagtcagtgtcgcaatgccgtgatccgtatcaagcgttacaccgctattttttccccagtttttattgagcttttcactatgtttcagtaagtttctgccaccaatctgcaactgattaaacttagcttcaagcgtttcactcttgactgcaagcgacttgttttcattgctaaccgtctgctcaagtgctgtgattttggatgttaaatctaacttagttgcattgacttcatcagtccattctgactttaactcttttctcgcaagtgacgccacttcatctttgctagctttcgtttcttttaagtcagaaatgccactagtattttgcgccactttagaatcgagcgtttctagttttgtagagaaagatttgtctttttcgctagccgttttttgaattagctgtatttcactttcgctcaatccaactctagcagttagactgtctagcttgtcagcagtagatttattcacagtcgcttgtgattgcttgtgttgaataatatccgcgcttacttccgagatagccacgtcga

SEQ ID NO: 85 - protein, 103 aa, Pasteurella multocida
MTKLSIQRDNLICLSYVALMGFGFPIMRYMSIHFDTLNNNAVRFLSGGSVFILACFFYYRAELTSSGAGVQSVAMLPSSSLGFLILKTVPSFSYVTISTLNRV

SEQ ID NO: 86 - DNA, 19 bp, Artificial Sequence
  PRIMER
aggccggtaccggccgcct

SEQ ID NO: 87 - DNA, 19 bp, Artificial Sequence
  PRIMER
cggccggtaccggcctagg

SEQ ID NO: 88 - DNA, 18 bp, Artificial Sequence
  PRIMER
catggtacccattctaac

SEQ ID NO: 89 - DNA, 18 bp, Artificial Sequence
  PRIMER
ctaggtacctacaacctc

SEQ ID NO: 90 - DNA, 119 bp, Artificial Sequence
  transposon insert
  misc_feature (25)..(25): n is a, c, g, or t
  misc_feature (27)..(27): n is a, c, g, or t
  misc_feature (29)..(29): n is a, c, g, or t
  misc_feature (31)..(31): n is a, c, g, or t
  misc_feature (33)..(33): n is a, c, g, or t
  misc_feature (35)..(35): n is a, c, g, or t
  misc_feature (37)..(37): n is a, c, g, or t
  misc_feature (39)..(39): n is a, c, g, or t
  misc_feature (41)..(41): n is a, c, g, or t
  misc_feature (43)..(43): n is a, c, g, or t
  misc_feature (45)..(45): n is a, c, g, or t
  misc_feature (47)..(47): n is a, c, g, or t
  misc_feature (49)..(49): n is a, c, g, or t
  misc_feature (51)..(51): n is a, c, g, or t
  misc_feature (53)..(53): n is a, c, g, or t
  misc_feature (55)..(55): n is a, c, g, or t
  misc_feature (57)..(57): n is a, c, g, or t
  misc_feature (59)..(59): n is a, c, g, or t
  misc_feature (61)..(61): n is a, c, g, or t
  misc_feature (63)..(63): n is a, c, g, or t
  misc_feature (65)..(65): n is a, c, g, or t
  misc_feature (67)..(67): n is a, c, g, or t
  misc_feature (69)..(69): n is a, c, g, or t
  misc_feature (71)..(71): n is a, c, g, or t
  misc_feature (73)..(73): n is a, c, g, or t
  misc_feature (75)..(75): n is a, c, g, or t
  misc_feature (77)..(77): n is a, c, g, or t
  misc_feature (79)..(79): n is a, c, g, or t
  misc_feature (81)..(81): n is a, c, g, or t
  misc_feature (83)..(83): n is a, c, g, or t
  misc_feature (85)..(85): n is a, c, g, or t
  misc_feature (87)..(87): n is a, c, g, or t
  misc_feature (89)..(89): n is a, c, g, or t
  misc_feature (91)..(91): n is a, c, g, or t
  misc_feature (93)..(93): n is a, c, g, or t
ctaggtacctacaacctcaagcttnknknknknknknknknknknknknknknknknknknknknknknknknknknknknknknknknknknkaagcttggttagaatgggtaccatg

SEQ ID NO: 91 - DNA, 18 bp, Artificial Sequence
  PRIMER
tacctacaacctcaagct

SEQ ID NO: 92 - DNA, 18 bp, Artificial Sequence
  PRIMER
tacccattctaaccaagc

SEQ ID NO: 93 - DNA, 19 bp, Artificial Sequence
  PRIMER
tacctacaacctcaagctt

SEQ ID NO: 94 - DNA, 20 bp, Artificial Sequence
  PRIMER
tacccattctaaccaagctt

SEQ ID NO: 95 - DNA, 19 bp, Artificial Sequence
  PRIMER
ggcagagcattacgctgac

SEQ ID NO: 96 - DNA, 27 bp, Artificial Sequence
  PRIMER
gtaccggccaggcggccacgcgtattc

SEQ ID NO: 97 - DNA, 531 bp, Actinobacillus pleuropneumoniae
  misc_feature: atpG
tgttgagcttggtttagtagggtcgaaaggcgtaagcttttaccaaaatctaggcttaaacgtgagatctcaagtaacgggattaggcgataatccggaaatggaacgtatcgtgggcgcagttaatgaaatgattaatgcgttccgaaacggagaagtggatgcggtttacgtcgcttacaaccgttttgaaaatacgatgtcacaaaaacctgttatcgcacagttacttccgttacctaaactagatgacgatgaattagatacgaaaggttcatgggattatatttatgaaccgaatccacaagttttattggatagtttacttgttcgttatttagaaactcaggtataccaagcagttgtagataacctagcttctgaacaagccgctcgaatggtagcgatgaaagccgcaacagataatgcgggtacattaatcgatgaattacaattagtgtataacaaagctcgccaagcaagcattacaaatgaattaaacgaaattgttgcgggtgccgcagcaattta

SEQ ID NO: 98 - DNA, 25 bp, Artificial Sequence
  PRIMER
tctccattcccttgctgcggcaccc

SEQ ID NO: 99 - DNA, 20 bp, Artificial Sequence
  PRIMER
ggattacagccggatccggg

SEQ ID NO: 100 - DNA, 1034 bp, Pasteurella multocida
  CDS (1)..(1032): cap5E
atgtttaaaaataaaacacttttaattacaggtggaacgggttcttttggtaatgctgtactcaaacgtttcttagaaacagatattcgagaaattcgtgttttttcgcgtgatgagaagaaacaagatgacatgcggaaaaaatataatgatgcaaaattaaaattttatattggcgatgttcgtgactacgatagtattttaaatgcctcgcgaggtgttgactatatttatcatgctgccgcattaaagcaagtgccttcatgcgagttttatccgttagaggcagtgaaaaccaatattttaggtacggcaaatgtcttagaagccgccatccaaaaccagataaaacgcgtcgtctgtcttagcacagataaagcggtgtacccaattaatgcgatgggcatttctaaagcaatgatggaaaaagtcatcatcgcaaaatcgcgtaacctagaaggcacaccaacgacaatctgttgtactcgctatggcaatgtcatggcatcgcgtggttcggttatcccattatttgtcgatcaaatacgtcaaggcaagccttttactattactgatcctgagatgacacgctttatgatgacattggaagatgctgtggatttagtcctatatgcatttaaaaatggtcaaaatggtgatgtttttgtacaaaaagcccccgcagcaaccattggtacccttgccaaagcaattaccgaattattatctgtcccaaatcaccctatttccattataggtacgcgtcatggagagaaagcattcgaagctttattaagccgtgaagaaatggttcatgcaattaatgaaggtaattattatcgcatcccagccgatcaacgcagtttaaattacagtaaatatgtcgaaaaaggggaaccaaaaattaccgaagtcaccgactacaactcacataatactgagcgtttgactgtcaaggaaatgaagcagttactgcttaaacttgaattcatacagaaaatgattgagggtgaatacatctcaccggaggtata

SEQ ID NO: 101 - protein, 344 aa, Pasteurella multocida
MFKNKTLLITGGTGSFGNAVLKRFLETDIREIRVFSRDEKKQDDMRKKYNDAKLKFYIGDVRDYDSILNASRGVDYIYHAAALKQVPSCEFYPLEAVKTNILGTANVLEAAIQNQIKRVVCLSTDKAVYPINAMGISKAMMEKVIIAKSRNLEGTPTTICCTRYGNVMASRGSVIPLFVDQIRQGKPFTITDPEMTRFMMTLEDAVDLVLYAFKNGQNGDVFVQKAPAATIGTLAKAITELLSVPNHPISIIGTRHGEKAFEALLSREEMVHAINEGNYYRIPADQRSLNYSKYVEKGEPKITEVTDYNSHNTERLTVKEMKQLLLKLEFIQKMIEGEYISPEV

SEQ ID NO: 102 - DNA, 4931 bp, Pasteurella multocida
  CDS (1)..(4929): fhaB2
  misc_feature (4894)..(4894): n is a, c, g, or t
atgaacaaaaatcgttacaaactcatttttagtcaagtcaaaggttgtctcgttcctgtggcagaatgtattaactcagctattagcaatggttcatctgattcaacatccacatcagaacaagttgaagaggaacctttccttctagaacaatattcactttcctccgtgtctttattagtaaaaagcacgttcaatcctgtttcgtatgcaatgcaattgacttggaaacagctttctattttatttttaactgtgatttctgttcctgttttggctgagggaaaaggggatgaaagaaatcaattaacagtgattgataatagcgatcatattaaattagatgcatctaatcttgctggtaatgataaaacaaaaatctatcaagcagaaaataaagttctggttattgatattgctaaaccaaatgggaaagggatttcagataaccgttttgaaaaatttaatattccaaatagcgcggtgtttaataataatgggactgaagcgcaggcaagatcaacattaattggttacattccgcaaaatcaaaatttaaggggagggaaagaagctgatgttatattaaatcaagtgacaggtcctcaagaaagtaaaattgttggcgcgcttgaagtattaggtaaaaaagctgatatcgtcattgcaaaccaaaatggtattaccttaaatggtgtaagaacaataaattcagatcgttttgttgccactacgagtgagcttatagatccgaatcagatgatgttaaaggttacaaaaggaaatgtgatcattgatattgatggtttttcgacagatggattaaagtatttagatattattgctaaaaaaattgaacaaaagcaatcaattacatcaggggataattcagaagcaaaaacagatgtcactcttattgcgggttccagtgaatatgatttaagcaaacatgagctgaaaaaaacgagcggtgaaaatgtatctaatgatgttattgctatcacgggatctagtacaggcgcaatgcatggtaaaaatattaagttgattgtgacagataaaggtgcaggcgtaaaacatgatggaattattttgtctgaaaatgatattcagattgaaatgaatgaaggtgacttagaacttggcaatacgattcagcaaacagtggtaaaaaaagaccgaaatattcgagccaagaaaaaaattgaagtgaaaaacgctaatcgtgtttttgttggtagtcaaacgaaatcagatgaaatttcgttagaggcgaaacaagttaaaatcagaaaaaacgcagagattaggagtacgacacaagccaaaatcgtagcaaagggtgccctgtctattgagcaaaatgcgaagctcgtcgctaaaaagatagatgtggcaacagaaactctaactaatgctgggcgtatttatggtcgagaggttaagcttgacactaataatttgattaatgataaagaaatttatgctgaacggaaattgagtattttgacgaaaggaaaagatcttgaaattattcaagatagatatttgtctccactgatgcgcgtaaaaagtagtgtccgctttttaggctctccgtttttctcaatatctccgtcgatgctcgcaagccttagtgcacagtttaagcctggttttgtgaataagggactcattgaaagtgcggggagtgcagaattaacttttaaagaaaaaaccagttttttaacagagggcaataattttattagagctaaagatgcgttaactattaacgcccaaaatattgaaattgataaaaatcaagatattcaattgggtgctaatataacgttgaatgtggaagaaaactttgttaatcgtgcaggaacactggcaactggtaaaacactgacaattaataccgaaagtggcagtatttacaatcttggtgggacattaggtgctggaaaatcattaaaactgactgctaaatcaacggaagaaggtatgggaaatattgttaaccaagaaaacggtttattccatacactcggtaatatgatgttagaagcagagcgttctgtttataatattggcgatatttatgcgagtaaaaaattaacagttcatactcataatttgattaatgatgtgcgtttatctggcaatgtgagttataagcctatcggttcaagtcgtgattatgatatcagtcgtgttgcggtacatggttggcacaataatgtttataagctcaacttaaatctgcaagaacaagataaaaccgatattaaagttgtgaaaatgggggctatccgttctgatggtgattttgactttaagggaataaaggcgacatcatcagaatcaaaaccgcagttaattaatcatggattaattaatgtcaaaggaacatttaatgcggaagctgatcaagtggtgaaccaaatgaaagcgtttaaccaaaatgcattagcaagcgtgtttaagaatccagcgaaaatcacgatgtactatcaaccacttactcgttatatttggacaccattatcgggtaatgcatcgcgtgaatttaacaatttagagtctttcctcgatgccttgtttggctcaacaacaatcttaaaatcaagtttctatagtacggaaaattttagtgcttatcagcttctatctcatattcagcattcaccaatgtaccaaaaagcgatggcacaagtgtttggtgcagagtggcatagtaaatcctatgatgagatgcgaaacaaatggaaaagctttaaagaaaatccaacagatttcatttattacccatcagaaaaagcaaaaatcctagcgggaaaactagaaggtaagcttacaacgctacaaaatggtgaatatgccgaacgtggtaagtttgatgagagtatccaaattggtaaacaccaattatcgctaccatcagtagagcttaaagcggagtttagtgataaagaacgtttggaagaggacggggtagatttatcctcgatcgccgaactcttagaaatgccaaacttatttattgataatagtatccaattagaaaagaaaaagttgtctcctattgaggatctagatgaagaaccacgtaaaaatctggatatagaagaaagccattctaattcatcggatgacgtgcttagcatgaatgatgatgagtctgatacagacgatagcaagtggagtatgggcaatgatgagaaagagatgcccgatgataagctgggtataagtcgtgatgatcgtggaaataaaccacctcgtactgatcctacagttgattatcttaaccctgatgaattctttgaaaatggttatctcttgaatgagctactacaggagcttggagaagagccgttactaaaagaaggggaagatcattttaaacgttctaccaatctagtccgtctaggcgagagagataggcaaaatagagaaaagagagaaaaagaggggtattttgatctgcctggtacattagatatgaaactgcaggagttattcgaaaaaagaaaacaaaaacacgaagcagaacagaaagcaagaatagaaaaagcacttctacaaaaatcagaacaacaagaaaaacgtgttgaagaacgtaagcaagaggaaaaacgtcaagcgcaagataaaattgctaagcaagtagaaattgcaaaagaaatgcaacgggtagaagaaattcgccagagagaaaaacaacttgcgatccaactgcaagaagaagagaagaaacaacaagaagaaaaacatttatccgaggagaaaaaacaagctgaacagaaacaaaaagctgaggagaaagttgcacaagaaagattagacattgaacaacagaaagcgtatgaagaaatggcgaagcgagaggcagaggcatcaaaaaatgttttattgaaagcgattgatgaagaacgtccaaaagtggaaactgatccacttttccgtacaaaattgaaatatatcaatcaagatgactatgctggtgcaaattatttcttcaataaagttggtttaaatacaaaaggtcatcaaaaagtaaatgtgttaggggataactattttgatcatcaagtgattactcgctcgattgagaaaaaagtagataaccaccttaaccaaaaatacaatctcagcgatgtggaattagttaaacagctgatggacaattccacaacacaagcgcaggagttggatttgaaactaggtgcggcattaactaaagaacaacaagctaacttgacccaagatatcgtttggtatgtcaaaacgaaggtaaagggcaaagatgtgtttgttccaaaggtttatttcgcttctgaaacgctcgtagaagcccaaaaattacaaggtttaggcactgggactatcagagttggtgaagctaagattaaagccaaagatgtggtgaataccgggacattagctgggagaaaactcaatgttgaagcgagtaataaaatcaaaaatcaagggagtatcttaagtactcaagaaacacgtttagtcgggcgtaaaggtattgaaaacgtatctcgttcatttgcaaatgatgaattaggagtcactgcacaacgctcagaaatcaaaacggaaggtcatttacatcttgaaacagataaggattcaactattgatgtacaagcatcggatattaaagcaaaaacaagctttgtgaagactggtgatgtgaatctcaaaaatacatacaatactaaacatgcctaccgtgagaaattctcgccgagtgcactacaagttgcagaacttgatgtggcagggcttaaagtcccacttttaggcgtgtccgtctccatccagtttattcagagcatactagtgaggcaacttcaagagggatcaatcttcgaagtagggcacttacatnttgcggtagacagaagatgtgaaccaagcggggagta

SEQ ID NO: 103 - protein, 1643 aa, Pasteurella multocida
  misc_feature (1632)..(1632): The 'Xaa' at location 1632 stands for Ile, Val, Leu, or Phe.
MNKNRYKLIFSQVKGCLVPVAECINSAISNGSSDSTSTSEQVEEEPFLLEQYSLSSVSLLVKSTFNPVSYAMQLTWKQLSILFLTVISVPVLAEGKGDERNQLTVIDNSDHIKLDASNLAGNDKTKIYQAENKVLVIDIAKPNGKGISDNRFEKFNIPNSAVFNNNGTEAQARSTLIGYIPQNQNLRGGKEADVILNQVTGPQESKIVGALEVLGKKADIVIANQNGITLNGVRTINSDRFVATTSELIDPNQMMLKVTKGNVIIDIDGFSTDGLKYLDIIAKKIEQKQSITSGDNSEAKTDVTLIAGSSEYDLSKHELKKTSGENVSNDVIAITGSSTGAMHGKNIKLIVTDKGAGVKHDGIILSENDIQIEMNEGDLELGNTIQQTVVKKDRNIRAKKKIEVKNANRVFVGSQTKSDEISLEAKQVKIRKNAEIRSTTQAKIVAKGALSIEQNAKLVAKKIDVATETLTNAGRIYGREVKLDTNNLINDKEIYAERKLSILTKGKDLEIIQDRYLSPLMRVKSSVRFLGSPFFSISPSMLASLSAQFKPGFVNKGLIESAGSAELTFKEKTSFLTEGNNFIRAKDALTINAQNIEIDKNQDIQLGANITLNVEENFVNRAGTLATGKTLTINTESGSIYNLGGTLGAGKSLKLTAKSTEEGMGNIVNQENGLFHTLGNMMLEAERSVYNIGDIYASKKLTVHTHNLINDVRLSGNVSYKPIGSSRDYDISRVAVHGWHNNVYKLNLNLQEQDKTDIKVVKMGAIRSDGDFDFKGIKATSSESKPQLINHGLINVKGTFNAEADQVVNQMKAFNQNALASVFKNPAKITMYYQPLTRYIWTPLSGNASREFNNLESFLDALFGSTTILKSSFYSTENFSAYQLLSHIQHSPMYQKAMAQVFGAEWHSKSYDEMRNKWKSFKENPTDFIYYPSEKAKILAGKLEGKLTTLQNGEYAERGKFDESIQIGKHQLSLPSVELKAEFSDKERLEEDGVDLSSIAELLEMPNLFIDNSIQLEKKKLSPIEDLDEEPRKNLDIEESHSNSSDDVLSMNDDESDTDDSKWSMGNDEKEMPDDKLGISRDDRGNKPPRTDPTVDYLNPDEFFENGYLLNELLQELGEEPLLKEGEDHFKRSTNLVRLGERDRQNREKREKEGYFDLPGTLDMKLQELFEKRKQKHEAEQKARIEKALLQKSEQQEKRVEERKQEEKRQAQDKIAKQVEIAKEMQRVEEIRQREKQLAIQLQEEEKKQQEEKHLSEEKKQAEQKQKAEEKVAQERLDIEQQKAYEEMAKREAEASKNVLLKAIDEERPKVETDPLFRTKLKYINQDDYAGANYFFNKVGLNTKGHQKVNVLGDNYFDHQVITRSIEKKVDNHLNQKYNLSDVELVKQLMDNSTTQAQELDLKLGAALTKEQQANLTQDIVWYVKTKVKGKDVFVPKVYFASETLVEAQKLQGLGTGTIRVGEAKIKAKDVVNTGTLAGRKLNVEASNKIKNQGSILSTQETRLVGRKGIENVSRSFANDELGVTAQRSEIKTEGHLHLETDKDSTIDVQASDIKAKTSFVKTGDVNLKNTYNTKHAYREKFSPSALQVAELDVAGLKVPLLGVSVSIQFIQSILVRQLQEGSIFEVGHLHXAVDRRCEPSGE

SEQ ID NO: 104 - DNA, 2009 bp, Pasteurella multocida
  CDS (1)..(2007): hmbR
atccgtggcgttgataaagatcgtgtcgctgttattgttgatggaataccgcaggctgaatcgactatatctacttccgcacgttattcgactgaacgtcataatggtaatattaataatattgaatacgaaaatgttagttcgttgaaagttcaaaaaggggcagcttctgtaatgtatggtagcggtgcgttaggtggaaccgtggagtttaccacaaaagatattgaggactttgtcgaacctggtcgccatttgggctttttgtctaaaaccggctatacttcaaaaaacagagaatatcgtcaagtcatcggagttggagggaaaggggaacacttttttggttttgtacaattaaccaaacgttgggggcatgaaacaatcaacaacggcaaaggtacagacattctcggcgaacatcgaggtaaacccaatccgctcaactactatactacatcatggttaacgaaagtcggttacgatattaataacactcatcgttttacactgtttttagaagatcgccgtgaaaagaagcttaccgaagaaaaaacattagggcttagtgatgcagtgcgttttgctaatgatcaaaccccttatctccgttatggtattgaatatcgatataacggcttgtcttggttggaaacggtaaagctttttttggcaaagcagaaaatcgaacaacgttctgctctccaagagtttgatattaataataggaataaattggattcgactatgtcgtttgtatatttacaaagacagaatatagctcggggagaattttcaacgagtcctttatattgggggccgagtcgccatcgtttatctgcgaaattcgaatttcgtgataagtttttagaaaatatgaataagcattttacgtttcggccgtggcaaatcaatagattcagacaacaaggtcgaaataactatacagaagtgtttcccgttaaatcccgagagttttctttttctcttatggacgacattaagattggcgaattgctacatctcggattgggcggtcggtgggatcactataactataagccattattaaattctcagcataatatcaacaggacacagagattaccttatccaaaaacatcatccaaattttcgtatcaattgagtttagagtatcaattacatccatcacatcaaattgcataccgtttaagtaccggttttagggttccccgtgttgaagatctttattttgaagaccgaggaaaaagttcttcacaatttcttcctaaccccgatctacaaccggaaactgcactgaatcatgaaataagttaccgtttccaaaatcaatatgcccatttcagcgtcgggcttttccgtacacgttatcataactttattcaagaacgtgagatgacctgtgataaaattccatatgagtataataggacttatggatattgcacgcataatacttatgtaatgtttgttaatgaacctgaagccgtgattaaaggggttgaagtaagcggtgctttaaatgggtcggcattcggactttccgacggtttaactttccgtctcaaagggagctacagcaaaggtcaaaatcatgacggcgatccgttaaaatctattcaaccatggacagtggtaaccggtattgattacgaaactgaagggtggagcgtgagtttgagcgggcgttatagtgcggctaaaaaagccaaagatgcgatagaaacggaatacacacatgataaaaaggttgtcaaacaatggccgcatttaagtccatcctactttgttgttgattttacggggcaagttaacctcagtaaaaatgtcattttgaatatgggggtatttaacttgttcaatcgtgattatatgacgtgggacagtgcatataacttgtttactagggggtatacttcccgttctgtccgtgctaacagcccaggcattaatcggtttaccgcaccaaaacgtaattttgctgcctcggtggaaattcgttttta

SEQ ID NO: 105 - protein, 669 aa, Pasteurella multocida
IRGVDKDRVAVIVDGIPQAESTISTSARYSTERHNGNINNIEYENVSSLKVQKGAASVMYGSGALGGTVEFTTKDIEDFVEPGRHLGFLSKTGYTSKNREYRQVIGVGGKGEHFFGFVQLTKRWGHETINNGKGTDILGEHRGKPNPLNYYTTSWLTKVGYDINNTHRFTLFLEDRREKKLTEEKTLGLSDAVRFANDQTPYLRYGIEYRYNGLSWLETVKLFLAKQKIEQRSALQEFDINNRNKLDSTMSFVYLQRQNIARGEFSTSPLYWGPSRHRLSAKFEFRDKFLENMNKHFTFRPWQINRFRQQGRNNYTEVFPVKSREFSFSLMDDIKIGELLHLGLGGRWDHYNYKPLLNSQHNINRTQRLPYPKTSSKFSYQLSLEYQLHPSHQIAYRLSTGFRVPRVEDLYFEDRGKSSSQFLPNPDLQPETALNHEISYRFQNQYAHFSVGLFRTRYHNFIQEREMTCDKIPYEYNRTYGYCTHNTYVMFVNEPEAVIKGVEVSGALNGSAFGLSDGLTFRLKGSYSKGQNHDGDPLKSIQPWTVVTGIDYETEGWSVSLSGRYSAAKKAKDAIETEYTHDKKVVKQWPHLSPSYFVVDFTGQVNLSKNVILNMGVFNLFNRDYMTWDSAYNLFTRGYTSRSVRANSPGINRFTAPKRNFAASVEIRF

SEQ ID NO: 106 - DNA, 908 bp, Pasteurella multocida
  CDS (1)..(906): lgtC
atgaatattttatttgtttctgatgatgtttatgctaaacatctggtggttgcgattaaaagcattataaatcataatgaaaaaggtatttcattttatatttttgatttgggtataaaggatgaaaataagagaaatattaatgatattgtttcttcttatggaagtgaagtcaactttattgctgtgaatgagaaagaatttgagagttttcctgttcaaattagttatatttctttagcaacatatgcaaggctaaaagcggcagagtatttgccggataatttaaataaaattatttatttagatgttgatgttttggtttttaactcattagaaatgttatggaatgttgatgttaataattttcttaccgcagcctgttatgattctttcatcgaaaatgaaaagtctgagcataaaaaatcgatttcaatgtcagataaggaatattattttaatgcaggagtaatgctatttaatttagatgaatggcggaagatggatgtattctcaagagctttagacctgttagctatgtatcctaatcaaatgatttatcaggatcaagatatattgaatatcctttttaggaataaagtctgttatttagattgcagatttaatttcatgccaaatcaacttgaaagaataaaacaataccataaaggaaaattgagcaacttacattctttagaaaaaacaacgatgcctgtcgttatttcacattattgtggtccagaaaaagcgtggcatgcggattgtaaacattttaatgtatatttctatcagaaaatattagcagaaataacgagaggcacggataaagaacgcgtattatctataaaaacttatctcaaggccttgattagaaggattagatataaattcaaatatcaagtctatta

SEQ ID NO: 107 - protein, 302 aa, Pasteurella multocida
MNILFVSDDVYAKHLVVAIKSIINHNEKGISFYIFDLGIKDENKRNINDIVSSYGSEVNFIAVNEKEFESFPVQISYISLATYARLKAAEYLPDNLNKIIYLDVDVLVFNSLEMLWNVDVNNFLTAACYDSFIENEKSEHKKSISMSDKEYYFNAGVMLFNLDEWRKMDVFSRALDLLAMYPNQMIYQDQDILNILFRNKVCYLDCRFNFMPNQLERIKQYHKGKLSNLHSLEKTTMPVVISHYCGPEKAWHADCKHFNVYFYQKILAEITRGTDKERVLSIKTYLKALIRRIRYKFKYQVY

SEQ ID NO: 108 - DNA, 2054 bp, Pasteurella multocida
  CDS (1)..(2052): pnp
atggcaagtatggatgatactactgtgtttgtcacagtggttgccaaaaaagatgtgaaagaaggtcaagacttcttcccattaactgttaactatcaagagcgtacttatgctgcaggccgtattcctggtggctttttcaaacgtgaaggtcgtccttctgaaggcgaaactttaattgctcgtttaattgaccgtccaattcgtcctcttttcccagaaggtttttataacgaaatccaaatcgtggcgacagtggtgtctgttaatccgcaaatttgtccagatttagtggcaatgatcggtgcatctgcggcactttctttatcaggtgtgccatttaatggccctatcggtgcggcacgtgttggttttattgatgatcaatttgtgttaaacccaaccatgaacgagcaaaaacaaagccgtttagacttggttgtcgcgggaacagataaagcggtgttaatggtggaatctgaagccgatgtattaaccgaagaacaaatgttagctgcggtggtgtttggtcatcagcaacaacaagtggtgattgacgcgatcaaagaatttaccgcagaagccggtaaaccgcgttgggattgggtggcacctgaaccaaataccgcgttaattgaaaaagtgaaagcgattgcagaagcgcgtttaggcgaagcataccgtatcactgaaaaacaagcacgttatgaacaaattgatgcgattaaagctgatgtgattgcacaaatcacagctgaagtagcagaaggcgaagacatcagtgaagggaaaattgtcgatattttcaccgcacttgaaagccaaatcgtacgtagccgtatcattgctggtgaaccacgtattgatggtcgtacagtggatactgttcgtgcattagatatttgtactggtgttttaccacgtacacacggttctgcgattttcacccgtggtgaaacacaggcgttagctgtcgcgacattaggtacagaacgtgatgcacaaattattgatgaattaacaggtgagcgttcagatcacttcttattccactacaacttcccgccatattctgtgggtgaaaccggtatgattggttcaccaaaacgtcgtgaaattggtcatggtcgtttagcgaaacgcggtgtagctgcagtgatgccaacacttgccgagttcccgtatgtggtacgtgttgtctctgaaatcacagaatcaaatggttcttcttctatggcatcggtttgtggtgcgtctttagcattaatggatgcgggtgtaccaattaaagcggcggttgcaggtattgcaatgggcttagtcaaagaagacgaaaaatttgtggtgctttcagacatcttaggtgatgaagatcacttaggtgacatggacttcaaagtcgcgggtacacgtacgggtgtgacggcattacaaatggatatcaaaatcgaaggtatcacagcagaaatcatgcaaattgcgttaaaccaagcgaaaagcgcacgtttacacattttaggtgtgatggagcaagcgatcccagcgccacgtgcggatatttctgattttgcaccgcgtatttacactatgaaaattgatccgaagaaaatcaaagatgtgatcggtaaaggtggtgcaaccattcgtgccttaacagaagaaacaggtacctcaattgatatcgatgatgatggtacggtgaagattgctgcggttgatggcaattcagcaaaagaggtgatggcgcgtattgaagatattactgcagaagttgaagcgggtgcagtgtataaaggtaaagttactcgtttagctgattttggtgccttcgtttctatcgtaggtaacaaagaaggcttagtgcatatttctcaaatcgcggaagagcgtgttgagaaagtgagtgattatcttgcagtggggcaagaagtgactgttaaagtggttgagattgatcgtcaaggtcgtattcgtttaaccatgaaagaagttgcaccaaagcaagaacacgttgattctgttgtcgcagacgttgccgcagaagaaaacgcata

SEQ ID NO: 109 - protein, 684 aa, Pasteurella multocida
MASMDDTTVFVTVVAKKDVKEGQDFFPLTVNYQERTYAAGRIPGGFFKREGRPSEGETLIARLIDRPIRPLFPEGFYNEIQIVATVVSVNPQICPDLVAMIGASAALSLSGVPFNGPIGAARVGFIDDQFVLNPTMNEQKQSRLDLVVAGTDKAVLMVESEADVLTEEQMLAAVVFGHQQQQVVIDAIKEFTAEAGKPRWDWVAPEPNTALIEKVKAIAEARLGEAYRITEKQARYEQIDAIKADVIAQITAEVAEGEDISEGKIVDIFTALESQIVRSRIIAGEPRIDGRTVDTVRALDICTGVLPRTHGSAIFTRGETQALAVATLGTERDAQIIDELTGERSDHFLFHYNFPPYSVGETGMIGSPKRREIGHGRLAKRGVAAVMPTLAEFPYVVRVVSEITESNGSSSMASVCGASLALMDAGVPIKAAVAGIAMGLVKEDEKFVVLSDILGDEDHLGDMDFKVAGTRTGVTALQMDIKIEGITAEIMQIALNQAKSARLHILGVMEQAIPAPRADISDFAPRIYTMKIDPKKIKDVIGKGGATIRALTEETGTSIDIDDDGTVKIAAVDGNSAKEVMARIEDITAEVEAGAVYKGKVTRLADFGAFVSIVGNKEGLVHISQIAEERVEKVSDYLAVGQEVTVKVVEIDRQGRIRLTMKEVAPKQEHVDSVVADVAAEENA

SEQ ID NO: 110 - DNA, 1514 bp, Pasteurella multocida
  CDS (1)..(1512): purF
atgtgtggtattgttggtattgttagccaaagccccgttaaccaatcaatttatgatgcgttaaccttattgcaacaccgcgggcaagacgccgccgggattgtaaccgtagatgatgaaaaccgattccgcttgcgtaaagcgaacgggttagtcagcgatgtatttgaacaagttcatatgttacgtttacaaggcaatgctggcattggacatgttcgttatcctacggctgggagctcaagtgtctctgaagcgcaacctttttatgtaaattcgccttatggcttaaccttagtgcataatggtaacttgaccaattcaagtgaattaaaagaaaagttatttcgtctcgcacgtcgccatgtaaataccaattcagattctgaattattactcaatatcttagccaatcaccttgatcacttcgaaaaataccaattagatccgcaagatgtattcagtgctgtcaaacaaacgcatcaggatattcgtggtgcttatgcttgtatcgccatgattattggtcatggtatggtcgcgtttcgtgatccgaacggtatccgtccgttagtgttagggaaacgcgaggaaaatggcaaaacagagtatatgtttgcctccgaaagtatcgcattagatacagtgggttttgagtttgtacgagatgtacaacccggcgaagcgatttatgtcacgtttgaaggggaaatgtatgctcagcaatgcgcagacaaaccaacattaacaccttgtatttttgaatacgtctattttgcacgtccagactcttgcatcgatggggtttctgtttatgctgcccgtgttcatatgggacaacgtttaggtgaaaaaattgcacgggaatgggcggatgtggatgatattgatgtggtcattcctgtgcctgaaacctctaacgatattgctttacgtattgcgcgcgtgttaaataaaccgtatcgtcaaggttttgtgaaaaatcgctatgtaggacgtacgtttattatgccggggcaggcattgcgagtcagttctgttagacgtaaactcaataccattgcttcagaatttaaagataagaatgtgttattagttgacgactcgattgtacgtggtaccacgtctgaacaaattgtcgaaatggcgagagcggcaggtgcgaagaaaatttattttgcctctgctgcaccagaaattcgttatccaaatgtgtatggtattgatatgccaaccaaaaatgaattgatcgcttatggtcgtgatgtagatgaaattgctaacttaattggtgtggataaattgattttccaagatttggatgcgttaactggttctgtgcaacaagaaaatccaagtattcaagactttgattgttcggtgtttacaggggtttatgtgacgggcgatattacacctgaatatctggataatattgcagaacagcgtaatgatatcgccaagaaaaagcgtgaaaaagatgctaccaatcttgaaatgcacaatgaaaaata

SEQ ID NO: 111 - protein, 504 aa, Pasteurella multocida
MCGIVGIVSQSPVNQSIYDALTLLQHRGQDAAGIVTVDDENRFRLRKANGLVSDVFEQVHMLRLQGNAGIGHVRYPTAGSSSVSEAQPFYVNSPYGLTLVHNGNLTNSSELKEKLFRLARRHVNTNSDSELLLNILANHLDHFEKYQLDPQDVFSAVKQTHQDIRGAYACIAMIIGHGMVAFRDPNGIRPLVLGKREENGKTEYMFASESIALDTVGFEFVRDVQPGEAIYVTFEGEMYAQQCADKPTLTPCIFEYVYFARPDSCIDGVSVYAARVHMGQRLGEKIAREWADVDDIDVVIPVPETSNDIALRIARVLNKPYRQGFVKNRYVGRTFIMPGQALRVSSVRRKLNTIASEFKDKNVLLVDDSIVRGTTSEQIVEMARAAGAKKIYFASAAPEIRYPNVYGIDMPTKNELIAYGRDVDEIANLIGVDKLIFQDLDALTGSVQQENPSIQDFDCSVFTGVYVTGDITPEYLDNIAEQRNDIAKKKREKDATNLEMHNEK

SEQ ID NO: 112 - DNA, 989 bp, Pasteurella multocida
  CDS (1)..(987): rci
atggcaacaataagaaaacgtggtaactcatatcgtgctgagataagcaaaaacggagtaaggaaatcagcaacatttaagactaaatcagaagctaatgcgtgggctgttgacgaggagagaaaattagctgatttggcaaaaggtatcgctccagatattatttttagagatgtaatagaacgctatcaaaatgaagtgtctataactaaaaaaggcgcgcgaaatgaaattataagattaaaccgctttttaagatatgatatttctaatctgtatattcgtgatttaagaaaagaagattttgaggagtggatcagaattcgcctaaccgaagtatcggatgctagcgttagacgtgagcttgttactatatcgtcagtgctgacaacagcaataaataagtggggatatatttcaaggcatccaatgactggtattgaaaaaccaaaaaactcggcagaaagaaaagaacgatattcagaacaggacattaaaacaatattagaaacagctagatattgtgaagataaactacccataacactcaaacaaagagtagcaattgcaatgttatttgctattgaaaccgctatgcgtgctggtgagattgctagtataaaatgggataatgtttttcttgaaaagagaatagtacatttaccgacaactaaaaacgggcactctagagatgtgccgctttcgcaaagagctgttgcgctaattttaaaaatgaaagaggtagaaaatggagatcttgtgtttcagaccacgcctgaatcattaagcaccacgtttagagtgttaaagaaagagtgtggacttgaacatctccattttcatgatacgagaagggaagcgttgacgagattatctaagaaagtagatgtaatgactctagccaaaattagcggacatagagatttaagaattttacaaaacacatattacgcaccgaatatgagtgaagtggcaaacttgttggatta

SEQ ID NO: 113 - protein, 329 aa, Pasteurella multocida
MATIRKRGNSYRAEISKNGVRKSATFKTKSEANAWAVDEERKLADLAKGIAPDIIFRDVIERYQNEVSITKKGARNEIIRLNRFLRYDISNLYIRDLRKEDFEEWIRIRLTEVSDASVRRELVTISSVLTTAINKWGYISRHPMTGIEKPKNSAERKERYSEQDIKTILETARYCEDKLPITLKQRVAIAMLFAIETAMRAGEIASIKWDNVFLEKRIVHLPTTKNGHSRDVPLSQRAVALILKMKEVENGDLVFQTTPESLSTTFRVLKKECGLEHLHFHDTRREALTRLSKKVDVMTLAKISGHRDLRILQNTYYAPNMSEVANLLD

SEQ ID NO: 114 - DNA, 1190 bp, Pasteurella multocida
  CDS (1)..(1188): sopE
atgtctgaagaatatctacatggtgtcaaagtcacagaaatcaatcaagcaattcgcacaattcaaagtctatcaaccgcagtcatcggtattgtctgtactgcaaatgacgcagacaatgaaacattcccactcaatgaacccgttctcatcacaaacgtggcagcggcaattggcaaggctggaaaacaaggcacgctttcacgtgcgcttgacgggatttctgatgtagtcaattgcaaagtgattgttgtgcgagtgcaagaaagtgcgcaagaagacgaagaaacaaaagcaagtgaaatgaacacggcaattattggcacaatcacagaagaagggcagtacacaggcttgaaggcgttattgattgcgaaaaacaaattcggtatcaaaccacgtattttatgtgtgccaaaattcgacacaaaagaagtcgccacagagcttgcaagtatcgccgccaaactcaacgcatttgcttacatttcatgtcaagggtgtaaaacgaaagaacaagcggtgcaatataaacgcaacttctcacaacgtgaagtcatgctgatcatgggcgattttctgtcatttaatgtcaacacatcaaaagttgagattgactatgccgtcactcgtgcggcggcaatgcgtgcatatcttgataaagaacagggctggcatacgtctatttcaaataaaggcattaatggcgtgagcggtgtcacacaaccactctattttgacattaacgacagctcgactgatgtgaactatctcaatgaacaaggcatcacgtgttgcgtgaatcataatggctttcgtttttggggcttacgcacgactgcagaagatccattattcaagtttgaagtgtacacccgcactgcacaaatcttaaaagatacgattgcaggggcgtttgattgggcagtggataaagatatttctgtcacgctagtgaaagatattattgaagcaatcaatgcgaagtggcgtgattacaccacaaaaggctacttaattggcggtaaagcgtggcttaataaagagcttaacagtgcaacgaatttaaaagatgcgaagttgttgatctcttatgattatcacccagtaccaccgctcgaacagctaggctttaatcagtacatttctgatgaataccttgttgatttttcaaatcgtttagcatcgta

SEQ ID NO: 115 - protein, 396 aa, Pasteurella multocida
MSEEYLHGVKVTEINQAIRTIQSLSTAVIGIVCTANDADNETFPLNEPVLITNVAAAIGKAGKQGTLSRALDGISDVVNCKVIVVRVQESAQEDEETKASEMNTAIIGTITEEGQYTGLKALLIAKNKFGIKPRILCVPKFDTKEVATELASIAAKLNAFAYISCQGCKTKEQAVQYKRNFSQREVMLIMGDFLSFNVNTSKVEIDYAVTRAAAMRAYLDKEQGWHTSISNKGINGVSGVTQPLYFDINDSSTDVNYLNEQGITCCVNHNGFRFWGLRTTAEDPLFKFEVYTRTAQILKDTIAGAFDWAVDKDISVTLVKDIIEAINAKWRDYTTKGYLIGGKAWLNKELNSATNLKDAKLLISYDYHPVPPLEQLGFNQYISDEYLVDFSNRLAS

SEQ ID NO: 116 - DNA, 2204 bp, Pasteurella multocida
  CDS (1)..(2202): unkK
atgaataaaaatcgctataaactcatttttagtaaaactaaaggctgtcttgtacctgttgctgaaacgattaattctgcagtaggaaatgcctcatcaaaagacgtttctgacaccgagataagtgcttctcaaccagcgctcaactcgccgctttcgaccctttctgtattagtcaaaaccgcatttaatccggtttcaacattgatgtcgttgacttggaaagaatacgccgttttattattaagtgtggtgtcttttcctcttatggcacaagcctctgatacagattcagtggtacaaagaaaacctgaattaactgatgtgacgaatagcaacagctatcatgtggaattagatagagagcatcataaaggggagcatcaaacaaaaatcaaacatactgagaataatgtcatcattgttgatattgcaaaaccaaaccaaaagggcatttcagataaccgttttaaacacttcaacatcccaaatggggcggtatttaacaatagcgccaaggaaaaacgctcacagttagtggggtatttgccaggtaaccagaatttaacggaaggtagtgaagcaaaagcgatcttaaatcaggtgactggaccggatgccagtaaaattgaaggcgcccttgaaattttagggcaaaaagccgatttggtgattgcgaaccaaaatggcattgtgcttaatggggtaaaaaccattaatgccaatcgttttgtggcaacaaccagtagtaccattgatcctgagcaaatgcagttaaatgtcacgcaaggtacagtgacaattggggtggatggatttgccacagatggcttaccttatttggatatcattgccaaaaagattgaacaaaaacaagcgattacaaaagaaagaacaggaaattccgaaaccgatatcacttttgtcgcaggtaacagtaaatatgatttaaagacacatcaagtgacagaaaagcataccgctgaggcacaaggtgaaattgcgattagcggtgcgagtaccggtgcaatgtacggtaaaaatatcaaattaatcgtaacggataaaggcgctggggtaaaacatgatggcattattttatctgaggcggatattcaaattgaaacccatgagggcgatgttgaattaggcaatacaaaaaataatcagaatgagaattatgccaaagctcatgcggaagggaattttacggttaaaggcggtaagcacgttattattggtaaggaagttaaagccaacaaagcggtcgatattcaagcacaagaaacaacagtaagacaaaatgcgaaattaactgccaaaacgagtgccaaaattacagcaagtaagagtgtgaatcttgaagataacgcgaaacttattgctaatgagctgagcacaacaaccaataaattaaccaataaaggtagcatttacggcaagaaagtgacgctagatgctgataatttagtcaatagtaaagaaatctatgcgtctagcgaacttgatattcaaaccaaaggtcgtgatcttttacttgaggatggggttaatcaaccactgagtttcttaaaaggcgcttcattgttagcgccggggtttgtcaacactgggctaattcacagtaacggtaatgccaagctcacttttaaagatgacaccagttttgtgactgaaggaaataactttatcacagcaaaagacaacttagaaatcacggcaaaaaatgttcaaattgatcaagcgaaaaatattcaattaaacgcgaatatcacgatcaataccaagtctggttttgtgaattacggtaccttagcaagtgctcaaaatttaacgattaataccgaacaaggcagcatttataacataggcggtatcttgggggcgggtaaaagtttgaatctgagcgcgaaaagaggagaaaaccaaggaggatatcttattaatcaaggtaagagtctactccattctgaaggcgccatgaacctcacagcggatcgcacggtgtacaatttagggaatatttttgctaaaggtgacgcgacgatcaatgcaaacgcgttaattaatgatgttactctcacaggtcgtcttgagtatcaagatctgaaaaaagattatacgcgttattatcgtatcaatgaaacggcaaaacatggttggcataataacttctatgaattaaacgtcgacagagtttcttg

SEQ ID NO: 117 - protein, 734 aa, Pasteurella multocida
MNKNRYKLIFSKTKGCLVPVAETINSAVGNASSKDVSDTEISASQPALNSPLSTLSVLVKTAFNPVSTLMSLTWKEYAVLLLSVVSFPLMAQASDTDSVVQRKPELTDVTNSNSYHVELDREHHKGEHQTKIKHTENNVIIVDIAKPNQKGISDNRFKHFNIPNGAVFNNSAKEKRSQLVGYLPGNQNLTEGSEAKAILNQVTGPDASKIEGALEILGQKADLVIANQNGIVLNGVKTINANRFVATTSSTIDPEQMQLNVTQGTVTIGVDGFATDGLPYLDIIAKKIEQKQAITKERTGNSETDITFVAGNSKYDLKTHQVTEKHTAEAQGEIAISGASTGAMYGKNIKLIVTDKGAGVKHDGIILSEADIQIETHEGDVELGNTKNNQNENYAKAHAEGNFTVKGGKHVIIGKEVKANKAVDIQAQETTVRQNAKLTAKTSAKITASKSVNLEDNAKLIANELSTTTNKLTNKGSIYGKKVTLDADNLVNSKEIYASSELDIQTKGRDLLLEDGVNQPLSFLKGASLLAPGFVNTGLIHSNGNAKLTFKDDTSFVTEGNNFITAKDNLEITAKNVQIDQAKNIQLNANITINTKSGFVNYGTLASAQNLTINTEQGSIYNIGGILGAGKSLNLSAKRGENQGGYLINQGKSLLHSEGAMNLTADRTVYNLGNIFAKGDATINANALINDVTLTGRLEYQDLKKDYTRYYRINETAKHGWHNNFYELNVDRVS

SEQ ID NO: 118 - DNA, 251 bp, Pasteurella multocida
  CDS (1)..(249): unkO
atgaaaattactattacacgaaatcatccagaagtatttcaagaatccgctcgtttagtagccgaaaagttcattaaagcccaatgtgtagaagcattaacattggctttgattgagggtgtcgagcactttgtgctggaaggtgaggaggaaagcaaaaggggacatagtattaaggttgtattaaaaggaagtcacgaagttattaagtcagaggtgaatacaaatgaaaaaaatcattgtaatcatta

SEQ ID NO: 119 - protein, 83 aa, Pasteurella multocida
MKITITRNHPEVFQESARLVAEKFIKAQCVEALTLALIEGVEHFVLEGEEESKRGHSIKVVLKGSHEVIKSEVNTNEKNHCNH

SEQ ID NO: 120 - DNA, 548 bp, Pasteurella multocida
  CDS (1)..(546): unkP
atgcgtgcatatcttgataaagaacagggctggcatacgtctatttcaaataaaggcattaatggcgtgagcggtgtcacacaaccactctattttgacattaacgacagctcgactgatgtgaactatctcaatgaacaaggcatcacgtgttgcgtgaatcataatggctttcgtttttggggcttacgcacgactgcagaagatccattattcaagtttgaagtgtacacccgcactgcacaaatcttaaaagatacgattgcaggggcgtttgattgggcagtggataaagatatttctgtcacgctagtgaaagatattattgaagcaatcaatgcgaagtggcgtgattacaccacaaaaggctacttaattggcggtaaagcgtggcttaataaagagcttaacagtgcaacgaatttaaaagatgcgaagttgttgatctcttatgattatcacccagtaccaccgctcgaacagctaggctttaatcagtacatttctgatgaataccttgttgatttttcaaatcgtttagcatcgta

SEQ ID NO: 121 - protein, 182 aa, Pasteurella multocida
MRAYLDKEQGWHTSISNKGINGVSGVTQPLYFDINDSSTDVNYLNEQGITCCVNHNGFRFWGLRTTAEDPLFKFEVYTRTAQILKDTIAGAFDWAVDKDISVTLVKDIIEAINAKWRDYTTKGYLIGGKAWLNKELNSATNLKDAKLLISYDYHPVPPLEQLGFNQYISDEYLVDFSNRLAS

SEQ ID NO: 122 - DNA, 69 bp, Actinobacillus pleuropneumoniae
  CDS (1)..(69): apvA-or1
atgttttatgtcatgcttgccaataggacgtctataatttcatcaatcgataagtttaagatacttagc

SEQ ID NO: 123 - protein, 23 aa, Actinobacillus pleuropneumoniae
MFYVMLANRTSIISSIDKFKILS

SEQ ID NO: 124 - DNA, 64 bp, Pasteurella multocida
  CDS (3)..(62): apvA-or2
agctaagtatcttaaacttatcgattgatgaaattatagacgtcctattggcaagcatgacata

SEQ ID NO: 125 - protein, 20 aa, Pasteurella multocida
LSILNLSIDEIIDVLLASMT

SEQ ID NO: 126 - DNA, 653 bp, Pasteurella multocida
  CDS (1)..(651): apvB
ttaattagctttccttttattacttttgcaagtaatgttaatggagccgaaattggattgggaggagcccgtgagagtagtatttactattctaaacataaagtagcaacaaatccctttttagcacttgatctttctttaggtaatttttatatgagagggactgcaggaattagcgaaataggatatgaacaatctttcactgacaatttcagcgtatcactgtttgttaacccatttgatggtttttcaattaaaggaaaagacttgttacctggatatcaaagtattcaaactcgcaaaactcaatttgcctttggttggggattaaattataatttgggaggtttattcggcttaaatgatacttttatatccttggaaggaaaaagcggaaaacgtggtgcgagtagtaatgtcagcttacttaaatcgtttaatatgacgaaaaattggaaagtttcaccatatattggctcaagttattattcatctaaatatacagattattactttggtattaaacaatccgaattaggtaataaaattacatccgtatataaacctaaagcagcttatgcaacacacataggtattaatactgattatgctttcacgaacaatcttggcatgggtttatctgtcggttggat

SEQ ID NO: 127 - protein, 217 aa, Pasteurella multocida
LISFPFITFASNVNGAEIGLGGARESSIYYSKHKVATNPFLALDLSLGNFYMRGTAGISEIGYEQSFTDNFSVSLFVNPFDGFSIKGKDLLPGYQSIQTRKTQFAFGWGLNYNLGGLFGLNDTFISLEGKSGKRGASSNVSLLKSFNMTKNWKVSPYIGSSYYSSKYTDYYFGIKQSELGNKITSVYKPKAAYATHIGINTDYAFTNNLGMGLSVGW

SEQ ID NO: 128 - DNA, 242 bp, Actinobacillus pleuropneumoniae
  CDS (1)..(240): apvC
atgtggcggatgggagattttatgtctaaaaaagagaggctgaatgatatggctcgccagattttatcagcggcggagttgctcattgcaaaggaaggtttgcaaaatttatcgatgaggaaaatcgcaagtgaagccggtatcgcaacaggcacgctttatctctatttcaaaacgaaagacgagttactggattgtttggcggaacaattacatgaacgatattatcgttatctgaatat

SEQ ID NO: 129 - protein, 80 aa, Actinobacillus pleuropneumoniae
MWRMGDFMSKKERLNDMARQILSAAELLIAKEGLQNLSMRKIASEAGIATGTLYLYFKTKDELLDCLAEQLHERYYRYLN

SEQ ID NO: 130 - DNA, 527 bp, Actinobacillus pleuropneumoniae
  CDS (1)..(525): apvD
aatattcaaaaaacagttattgctagcggcacattgcaagcgactgaacaagtagatattggtgcacaagtatctgggcagattaagcatattttagtacaagaaggacagaaggttaaaaaaggtgagctattagctgtaattgatccacgtctggctgaaacggaattaaaactagcaaaagctgagctagcaaatgcttctgctaatttggatacaaaaaaaattaatcttaagcaactgcaatcagattgggaacgtcatcaacgtttgatacgaaccaatgcgacaagccaaaaggaaacagaagaagcaaaaagtagattaaatacggccaaagcagaacttcaaattgcgcaaaataatctagatatcgctaaaatcagagtggaaaaagctgaaaccgaactaggatatacagaaattcgttctccacttgatgcaacagtaatttcagtatttgcgcaaaatggtcaaactttagtcaccacccaacaagtaccagtgctgatgaaattagctaatat

SEQ ID NO: 131 - protein, 175 aa, Actinobacillus pleuropneumoniae
NIQKTVIASGTLQATEQVDIGAQVSGQIKHILVQEGQKVKKGELLAVIDPRLAETELKLAKAELANASANLDTKKINLKQLQSDWERHQRLIRTNATSQKETEEAKSRLNTAKAELQIAQNNLDIAKIRVEKAETELGYTEIRSPLDATVISVFAQNGQTLVTTQQVPVLMKLAN

SEQ ID NO: 132 - DNA, 867 bp, Actinobacillus pleuropneumoniae
  CDS (1)..(864): atpG
atggcaggtgcgaaagagataagaaccaaaattgcaagtgtgaaaaatactcaaaaaatcaccaaagcaatggaaatggttgctacctctaaaatgcgtaaaacgcaagagcgtatggctgccagtcgtccttattcggaaacaatccgtaaggtgattagccatattgcgaaaggaagcattggttataagcacccgtttttaactgaacgtgatattaaaaaagtaggctatcttgtcgtttcgaccgatcgcggtttatgcggtggccttaatatcaatttattcaaagcgactttgaatgaatttaaaacgtggaaagataaagacgttagtgttgagcttggtttagtagggtcgaaaggcgtaagcttttaccaaaatctaggcttaaacgtgagatctcaagtaacgggattaggcgataatccggaaatggaacgtatcgtgggcgcagttaatgaaatgattaatgcgttccgaaacggagaagtggatgcggtttacgtcgcttacaaccgttttgaaaatacgatgtcacaaaaacctgttatcgcacagttacttccgttacctaaactagatgacgatgaattagatacgaaaggttcatgggattatatttatgaaccgaatccacaagttttattggatagtttacttgttcgttatttagaaactcaggtataccaagcagttgtagataacctagcttctgaacaagccgctcgaatggtagcgatgaaagccgcaacagataatgcgggtacattaatcgatgaattacaattagtgtataacaaagctcgccaagcaagcattacaaatgaattaaacgaaattgttgcgggtgccgcagcaatttaa

SEQ ID NO: 133 - protein, 288 aa, Actinobacillus pleuropneumoniae
MAGAKEIRTKIASVKNTQKITKAMEMVATSKMRKTQERMAASRPYSETIRKVISHIAKGSIGYKHPFLTERDIKKVGYLVVSTDRGLCGGLNINLFKATLNEFKTWKDKDVSVELGLVGSKGVSFYQNLGLNVRSQVTGLGDNPEMERIVGAVNEMINAFRNGEVDAVYVAYNRFENTMSQKPVIAQLLPLPKLDDDELDTKGSWDYIYEPNPQVLLDSLLVRYLETQVYQAVVDNLASEQAARMVAMKAATDNAGTLIDELQLVYNKARQASITNELNEIVAGAAAI

SEQ ID NO: 134 - DNA, 534 bp, Actinobacillus pleuropneumoniae
  CDS (1)..(531): atpH
atgtcagaattaagtacagtagctcgcccctacgctaaagcagcttttgattttgctttagaacaaggtcagttggacaaatggcaagaaatgttacagttttcggcattcgttgctgaaaacgaacaagtggcggaatatattaattcttcccttgcaagcggtcagatttctgaaacttttatcaaaatctgcggcgaccaacttgatcaatatgggcaaaattttattcgtgtaatggctgaaaataaacgtctggctgtgttgcctatggtttttgatactttcgtatcattacgagcggaacatgaagcggtaaaagatgtaacaattgtttcggcaaacgaattaagtcaagcacaagaagataaaatcgcaaaagcgatggaaaaacgcttaggtcaaaaagttcgtttaaccaaccaaatcgataacagcctgattgcaggcgtaattattaaatacgatgatgttgttattgatggtagtagccgcggtcagttaaatcgcttagcgtcagcgttgagcttgtaa

SEQ ID NO: 135 - protein, 177 aa, Actinobacillus pleuropneumoniae
MSELSTVARPYAKAAFDFALEQGQLDKWQEMLQFSAFVAENEQVAEYINSSLASGQISETFIKICGDQLDQYGQNFIRVMAENKRLAVLPMVFDTFVSLRAEHEAVKDVTIVSANELSQAQEDKIAKAMEKRLGQKVRLTNQIDNSLIAGVIIKYDDVVIDGSSRGQLNRLASALSL

SEQ ID NO: 136 - DNA, 321 bp, Actinobacillus pleuropneumoniae
  CDS (1)..(318): dksA
gcatggcatgtgcaaattatggacgaagctgagcgtacaaaaaaccaaatgcaggaagaagtcgctaatttcgccgatcctgcggaccgcgccactcaggaagaagaattcagtcttgaattaagaaaccgtgaccgtgagcgtaaattgcttaagaagattgagcaaacgttaaatagcattgccgaagacgaatacggctattgcgaaacttgcggtgttgaaatcggtttacgtcgtttagaagcgcgcccgaccgcggatatgtgtatcgattgcaaaacacttgcggaaatccgtgaaaagcaaatgggcttataa

SEQ ID NO: 137 - protein, 106 aa, Actinobacillus pleuropneumoniae
AWHVQIMDEAERTKNQMQEEVANFADPADRATQEEEFSLELRNRDRERKLLKKIEQTLNSIAEDEYGYCETCGVEIGLRRLEARPTADMCIDCKTLAEIREKQMGL

SEQ ID NO: 138 - DNA, 33 bp, Actinobacillus pleuropneumoniae
  CDS (1)..(30): dnaK
gctgagtttgaagaagtgaaagataataaataa

SEQ ID NO: 139 - protein, 10 aa, Actinobacillus pleuropneumoniae
AEFEEVKDNK

SEQ ID NO: 140 - DNA, 453 bp, Pasteurella multocida
  CDS (1)..(450): exbB
atggaacaaatgcttgaacttttacaaggtcatgttgattatattattttaggcttattactattaatgagtgttgtgttggtatggaaaattattgaacgcgtacttttctacaaacaattggatgtgaccaaatatgacacgctacaagatttggaaattgataccactcgcaatttaaccaccatttccactatcggtgccaacgccccttatatcggtttattaggaaccgtattagggatcttacttaccttctatcatttagggcattccggcggtgatattgacgccgcatccattatggttcacctttcgcttgcattaaaagcaaccgcagccggtatcttagtcgctattccggcaatgatgttctacagcggttttaaccgtaaagtggatgaaagcaaacttaaatggcaagcgattcaagctcgtaaagccaatcaataa

SEQ ID NO: 141 - protein, 150 aa, Pasteurella multocida
MEQMLELLQGHVDYIILGLLLLMSVVLVWKIIERVLFYKQLDVTKYDTLQDLEIDTTRNLTTISTIGANAPYIGLLGTVLGILLTFYHLGHSGGDIDAASIMVHLSLALKATAAGILVAIPAMMFYSGFNRKVDESKLKWQAIQARKANQ

SEQ ID NO: 142 - DNA, 720 bp, Actinobacillus pleuropneumoniae
  CDS (1)..(717): fkpA
atgttaaaaaataaactttctgttcttgcaatcgtagccggtacgttcgtttcagctcaaactgcatttgcagcggatcaaaaattcattgacgattcatcatatgcagtcggcgtattgatgggtaaaaatatcgaaggcgtcgttgaatcacaaaaagaaattttttcttataaccaagataaaatcttggcgggtgtccaagataccatcaaaaaaaccggtaaattaaccgatgaagatctacaaaaacaattaaaatcgcttgatacttatcttgcaagtcaagaaagcaaaattgcggcggagaaaagcaaagcaaccgtagaagccggtaataaatttcgtaccgactacgaaaaacaaagcggcgtgaaaaaaaccgcttccggtttactttataaaattgaaaaagccggcacgggcgaatcgcctaaagcggaagataccgttaaagttcactataaagggacattaaccgatggtacggtattcgatagctcatacgatcgcggtgagccgattgaattccaattaaaccaattaattccgggttggattgaagcgattccaatgttgaaaaaaggcggaaaaatggaaatcgtcgttccgcctgaacttggttacggcgaacgccaagcaggtaagattccggcaagttcaaccttaaaattcgagattgaattgttagatttcaaagcggccgaagcgaaaaaataa

SEQ ID NO: 143 - protein, 239 aa, Actinobacillus pleuropneumoniae
MLKNKLSVLAIVAGTFVSAQTAFAADQKFIDDSSYAVGVLMGKNIEGVVESQKEIFSYNQDKILAGVQDTIKKTGKLTDEDLQKQLKSLDTYLASQESKIAAEKSKATVEAGNKFRTDYEKQSGVKKTASGLLYKIEKAGTGESPKAEDTVKVHYKGTLTDGTVFDSSYDRGEPIEFQLNQLIPGWIEAIPMLKKGGKMEIVVPPELGYGERQAGKIPASSTLKFEIELLDFKAAEAKK

SEQ ID NO: 144 - DNA, 290 bp, Actinobacillus pleuropneumoniae
  CDS (3)..(287): HI0379
tgcatagcgtgagaggtccgggcggcggttatcaactcggtaagcaacctgaagagattagtgtggggatgattattgcggcggtgaatgaaaatctcgacgtaaccaaatgtaaaggtagcggcaactgtagcaaaaactctcagtgcttaacccatcatttatgggaacgtttagaagaacaaatcggtgtgtttttaaatacgattactttagcggaacttgttgaagaacattcggatcacgattgtgaaaaagaacattgccacgatcattcacacaaacattaa

SEQ ID NO: 145 - protein, 95 aa, Actinobacillus pleuropneumoniae
HSVRGPGGGYQLGKQPEEISVGMIIAAVNENLDVTKCKGSGNCSKNSQCLTHHLWERLEEQIGVFLNTITLAELVEEHSDHDCEKEHCHDHSHKH

SEQ ID NO: 146 - DNA, 273 bp, Actinobacillus pleuropneumoniae
  CDS (1)..(270): hupA
atgaacaaaactgagttaatcgatgcaatcgcagctggtgcagagttaagcaagaaagacgcgaaagcggcattagaagcgactttaaatgcgatctctgaaagcctaaaaaatggcgacaccgttcagttaatcggcttcggtacttttaaagtaaacgagcgtaatgcacgtacgggtcgtaacccgcgtaccggcgaagaaatcaaaatcgcagcatctaaagtgccggcgtttgttgcaggtaaagcattaaaagatttagtaaaataa

SEQ ID NO: 147 - protein, 90 aa, Actinobacillus pleuropneumoniae
MNKTELIDAIAAGAELSKKDAKAALEATLNAISESLKNGDTVQLIGFGTFKVNERNARTGRNPRTGEEIKIAASKVPAFVAGKALKDLVK

SEQ ID NO: 148 - DNA, 551 bp, Actinobacillus pleuropneumoniae
  CDS (1)..(549): 1pdA
atgagcaaagaaatcaaaacgcaagtcgtggtacttggtgcgggtcctgccggttattcagcggcattccgttgtgccgacttaggcttagaaacagtaattgtcgaacgttattcaactttgggcggtgtatgcttaaacgtaggttgtattccgtctaaagcattattacacgttgcaaaagttatcgaagaagcaaaacacgcagagaaaaacggtattactttcggtgagcccaacattgatttagataaagtgcgtgcgggtaaagaagcggttgtttctaaattaaccggcggtttagcgggtatggctaaagcacgtaaagtaacagtagtggaaggtttagcggcgtttaccgatccgaatactttagtagctcgtgaccgtgacggtaatccgacaacgattaaatttgattatgcaattattgcagccggttctcgtccgattcagcttccgttcattccacacgaagatccgcgtgtgtgggattctacggatgcacttaaattaaaagaagtacccgaaaaaattactcattatgggcc

SEQ ID NO: 149 - protein, 183 aa, Actinobacillus pleuropneumoniae
MSKEIKTQVVVLGAGPAGYSAAFRCADLGLETVIVERYSTLGGVCLNVGCIPSKALLHVAKVIEEAKHAEKNGITFGEPNIDLDKVRAGKEAVVSKLTGGLAGMAKARKVTVVEGLAAFTDPNTLVARDRDGNPTTIKFDYAIIAAGSRPIQLPFIPHEDPRVWDSTDALKLKEVPEKITHYG

SEQ ID NO: 150 - DNA, 1095 bp, Actinobacillus pleuropneumoniae
  CDS (1)..(1092): Opm5-2
atgaaaaaatcattagttgctttaacagtattatcggctgcagcggtagctcaagcagcgccacaacaaaatactttctacgcaggtgcgaaagcaggttgggcgtcattccatgatggtatcgaacaattagattcagctaaaaacacagatcgcggtacaaaatacggtatcaaccgtaattcagtaacttacggcgtattcggcggttaccaaattttaaaccaagacaaattaggtttagcggctgaattaggttatgactatttcggtcgtgtgcgcggttctgaaaaaccaaacggtaaagcggacaagaaaactttccgtcacgctgcacacggtgcgacaatcgcattaaaacctagctacgaagtattacctgacttagacgtttacggtaaagtaggtatcgcattagtaaacaatacatataaaacattcaatgcagcacaagagaaagtgaaaactcgtcgtttccaaagttctttaattttaggtgcgggtgttgagtacgcaattcttcctgaattagcggcacgtgttgaataccaatggttaaacaacgcaggtaaagcaagctactctactttaaatcgtatgggtgcaactgactaccgttcggatatcagttccgtatctgcaggtttaagctaccgtttcggtcaaggtgcggcaccggttgcagctccggcagttgaaactaaaaacttcgcattcagctctgacgtattattcgcattcggtaaatcaaacttaaaaccggctgcggcaacagcattagatgcaatgcaaaccgaaatcaataacgcaggtttatcaaatgctgcgatccaagtaaacggttacacggaccgtatcggtaaagaagcttcaaacttaaaactttcacaacgtcgtgcggaaacagtagctaactacatcgtttctaaaggtgctccggcagctaacgtaactgcagtaggttacggtgaagcaaaccctgtaaccggcgcaacatgtgacaaagttaaaggtcgtaaagcattaatcgcttgcttagcaccggatcgtcgtgttgaagttcaagttcaaggtactaaagaagtaactatgtaa

SEQ ID NO: 151 - protein, 364 aa, Actinobacillus pleuropneumoniae
MKKSLVALTVLSAAAVAQAAPQQNTFYAGAKAGWASFHDGIEQLDSAKNTDRGTKYGINRNSVTYGVFGGYQILNQDKLGLAAELGYDYFGRVRGSEKPNGKADKKTFRHAAHGATIALKPSYEVLPDLDVYGKVGIALVNNTYKTFNAAQEKVKTRRFQSSLILGAGVEYAILPELAARVEYQWLNNAGKASYSTLNRMGATDYRSDISSVSAGLSYRFGQGAAPVAAPAVETKNFAFSSDVLFAFGKSNLKPAAATALDAMQTEINNAGLSNAAIQVNGYTDRIGKEASNLKLSQRRAETVANYIVSKGAPAANVTAVGYGEANPVTGATCDKVKGRKALIACLAPDRRVEVQVQGTKEVTM

SEQ ID NO: 152 - DNA, 1110 bp, Actinobacillus pleuropneumoniae
  CDS (1)..(1107): Omp5
atgaaaaaatcattagttgctttagcagtattatcggctgcagcagtagctcaagcagctccacaacaaaatactttctacgcaggtgcgaaagttggtcaatcatcatttcaccacggtgttaaccaattaaaatctggtcacgatgatcgttataatgataaaacacgtaagtatggtatcaaccgtaactctgtaacttacggtgtattcggcggttaccaaatcttaaaccaaaataacttcggtttagcagctgaattaggctatgactactacggtcgcgtacgtggtaacgtagatgaattccgtacagttaaacactctgctcacggtttaaacttagcgttaaaaccaagctacgaagtattacctgacttagacgtttacggtaaagtaggtattgcggttgttcgtaatgactataaaaaatatggtgcggaaaacactaacgaatcaacaacaaaattccacaaattaaaagcatcaactattttaggtgcaggtgttgagtacgcaattcttcctgaattagcggcacgtgttgaataccaatacttaaacaaagcgggtaacttaaataaagcattagttcgttcaggcacacaagatgtggacttccaatatgctcctgatatccactctgtaacagcaggtttatcataccgtttcggtcaaggcgctgtagcaccagttgttgagccagaagttgtaactaaaaacttcgcattcagctcagacgttttatttgatttcggtaaatcaagcttaaaaccagcagcagcaacagctttagacgcagctaacactgaaatcgctaacttaggtttagcaactccagctatccaagttaacggttatacagaccgtatcggtaaagaagcttcaaacttaaaactttcacaacgccgtgcagaaactgtagctaactacttagtttctaaaggtcaaaaccctgcaaacgtaactgcagtaggttacggtgaagcaaacccagtaaccggcgcaacatgtgatgcagttaaaggtcgtaaagcattaatcgcttgcttagcaccggatcgtcgtgttgaagttcaagtacaaggtgctaaaaacgtagctatgtaa

SEQ ID NO: 153 - protein, 369 aa, Actinobacillus pleuropneumoniae
MKKSLVALAVLSAAAVAQAAPQQNTFYAGAKVGQSSFHHGVNQLKSGHDDRYNDKTRKYGINRNSVTYGVFGGYQILNQNNFGLAAELGYDYYGRVRGNVDEFRTVKHSAHGLNLALKPSYEVLPDLDVYGKVGIAVVRNDYKKYGAENTNESTTKFHKLKASTILGAGVEYAILPELAARVEYQYLNKAGNLNKALVRSGTQDVDFQYAPDIHSVTAGLSYRFGQGAVAPVVEPEVVTKNFAFSSDVLFDFGKSSLKPAAATALDAANTEIANLGLATPAIQVNGYTDRIGKEASNLKLSQRRAETVANYLVSKGQNPANVTAVGYGEANPVTGATCDAVKGRKALIACLAPDRRVEVQVQGAKNVAM

SEQ ID NO: 154 - DNA, 1076 bp, Actinobacillus pleuropneumoniae
  CDS (1)..(1074): pnp new
aatattaaagaattcgtaaaagaagcgggtaaaccgcgttgggattgggttgcgccggaaccgaataccgcattaatcaaccaagttaaagcgttagcggaagcgcgtatcggcgatgcgtatcgtattacagaaaaacaagcgcgttacgaacaaatcgatgcaattaaagcggatgttatcgcacaattaaccgcacaagacgaaaccgtttctgaaggtgcgattattgatattattaccgcattagaaagttctattgttcgcggtcgtattattgccggcgaaccgcgtattgacggtcgtacggtagatacggttcgtgcattagacatttgcaccggcgtattacctcgtacgcacggttctgcaatctttactcgcggtgaaacacaagcattagcggttgcaaccttaggtactgagcgcgatgcacaaattgttgacgaattaaccggcgagaaatcagaccgtttcttattccactataacttccctccgtactctgtcggtgaaaccggtcgtatcggttcgccgaaacgtcgtgaaatcggccacggtcgtttagcgaaacgcggtgtattagcggtaatgccgactgctgaagaattcccgtatgtagtgcgcgtagtatctgaaattaccgaatcaaacggttcttcttcaatggcttccgtatgcggcgcatctttagcgttaatggacgcaggcgtaccgattaaagcggcggttgcgggtatcgcaatgggcttagtgaaagaagaagaaaaatttgtggtgctttcagacatcttaggtgacgaagaccatttaggcgatatggacttcaaagtagccggtacgcgtgaaggtgtaaccgcacttcaaatggatattaaaatcgaaggtatcacgcctgaaattatgcaaatcgcattaaatcaagcgaaaggtgcgcgtatgcacatcttaagcgtgatggaacaagcgattcctgcacctcgtgccgatatttccgattttgcgcctcgtattcatacgatgaagatcgatccgaagaaaatcaaagacgtgatcggtaaaggcggtgcggttat

SEQ ID NO: 155 - protein, 358 aa, Actinobacillus pleuropneumoniae
NIKEFVKEAGKPRWDWVAPEPNTALINQVKALAEARIGDAYRITEKQARYEQIDAIKADVIAQLTAQDETVSEGAIIDIITALESSIVRGRIIAGEPRIDGRTVDTVRALDICTGVLPRTHGSAIFTRGETQALAVATLGTERDAQIVDELTGEKSDRFLFHYNFPPYSVGETGRIGSPKRREIGHGRLAKRGVLAVMPTAEEFPYVVRVVSEITESNGSSSMASVCGASLALMDAGVPIKAAVAGIAMGLVKEEEKFVVLSDILGDEDHLGDMDFKVAGTREGVTALQMDIKIEGITPEIMQIALNQAKGARMHILSVMEQAIPAPRADISDFAPRIHTMKIDPKKIKDVIGKGGAV

SEQ ID NO: 156 - DNA, 1055 bp, Actinobacillus pleuropneumoniae
  CDS (1)..(1053): potD
atgaaaaaattagcgggtttatttgcagcaggtttagcgacagttgcattaacagcgtgtaatgaagaaaagccaaaagcggctgaagcagcggctcaaccggcagcagcgggaacagttcacctttatacttggactgaatatgtgcctgaaggcttgttagatgaatttacaaagcaaaccggtatcaaagtagaggtttcaagccttgaatctaacgaaaccatgtatgcgaaattaaaattacaaggtaaagacggcggttacgatgttatcgcaccttctaactacttcgtttcaaaaatggcgaaagaaggtatgttagcggaattagatcacgcaaaacttcctgtaatcaaagagttaaaccaagattggttaaacaaaccttatgaccaaggtaacaaatactctttaccgcaattattaggtgcaccgggtatcgcatttaactcaaatgactataagggcgatgcgttcacttcttggggtgatttatggaaacctgagtttgcgaataaagtacaattattagatgacgcacgtgaagtatttaacattgcgttattaaaattaggtaaaaaccctaatacaaccaatccggaagagattaaagcggcttacgaagagttaagaaaattacgtccaaacgtactttctttcacttcagacaacccagcgaactcatttatcgcaggtgaagtatctgtaggtcaattatggaacggttctgtacgtattgcgaaaaaagaacaagcgccggtaaacatggtgttcccaaaagaaggtcctgtactttgggttgatacgttagccattccggcgaatgcgaaaaacaaagaaaatgcgcataagttaatcaactacttattaagcgcaccggttgcggaaaaattaacgttagaaatcggttatccgacttcaaacgtagaagcgttaaaaacattaccaaaagagattaccgaagatccggcaatctatccgacagctgatgtgttaaaagcggcacaatggcaagacgatgtaggtaatgcaatcgaactttacgaaaaata

SEQ ID NO: 157 - protein, 351 aa, Actinobacillus pleuropneumoniae
MKKLAGLFAAGLATVALTACNEEKPKAAEAAAQPAAAGTVHLYTWTEYVPEGLLDEFTKQTGIKVEVSSLESNETMYAKLKLQGKDGGYDVIAPSNYFVSKMAKEGMLAELDHAKLPVIKELNQDWLNKPYDQGNKYSLPQLLGAPGIAFNSNDYKGDAFTSWGDLWKPEFANKVQLLDDAREVFNIALLKLGKNPNTTNPEEIKAAYEELRKLRPNVLSFTSDNPANSFIAGEVSVGQLWNGSVRIAKKEQAPVNMVFPKEGPVLWVDTLAIPANAKNKENAHKLINYLLSAPVAEKLTLEIGYPTSNVEALKTLPKEITEDPAIYPTADVLKAAQWQDDVGNAIELYEK

SEQ ID NO: 158 - DNA, 525 bp, Actinobacillus pleuropneumoniae
  CDS (1)..(522): rpmF
atgcaaaaggtaaaactacccctcaccattgacccatataaagacgctcagcgtcgaatggattacgaaggctacatctcacgtagtctgcttaatcgtttgggtgaatctgtgagcaatgtgctaagcgatgcacaagttactctctcgttatatatcgatccgcaacgcttaaccgttattaaaggtacggcgacagtggaagtggaattcgattgccaacgatgcggtaacccgtttacacaaacgcttgactgttcgttttgtttcagtccggtgtccaatatggatcaggcggacaatttgcccgaaatttatgaaccaatcgaagtaaacgagttcggtgaagtaaatttactagatatgatcgaagatggatttatcatcgaattgcctctagtcccgatgcatagtgaagaacactgtgaagtgtccgtgagtgaacaggtgtttggcgaattgcctgaagaattggcgaaaaaacctaacccgttcgctgtattagctaatttaaagaaaaactag

SEQ ID NO: 159 - protein, 174 aa, Actinobacillus pleuropneumoniae
MQKVKLPLTIDPYKDAQRRMDYEGYISRSLLNRLGESVSNVLSDAQVTLSLYIDPQRLTVIKGTATVEVEFDCQRCGNPFTQTLDCSFCFSPVSNMDQADNLPEIYEPIEVNEFGEVNLLDMIEDGFIIELPLVPMHSEEHCEVSVSEQVFGELPEELAKKPNPFAVLANLKKN

SEQ ID NO: 160 - DNA, 1302 bp, Actinobacillus pleuropneumoniae
  CDS (1)..(1299): tig
atgtcaatttctattgaaactttagaaggcttacaacgccgcgtaactattaccgtagctgctgataaaatcgaagcggcttacaaagagcaattaaaaggctatgcgaaaaacgctcgtgtagacggtttccgtaaaggtaaagtaccgcacgcaattatcgaacaacgtttcggtttagcggctcgccaagacgtattatccgatgaaatgcaacgtgcgttctttgatgcggtaatcgctgagaaaattaaccttgccggtcgtcctaccttcacaccgaacaactaccaaccgagtcaagaattcagcttcactgcaacttttgaagtattcccggaagttgaattaaaaggcttagaaaatatcgaagttgaaaaaccggttgtagaaatcacagaagctgatttagacaaaatgatcgatgtgttacgtaaacaacaagcgacttgggctgaatctcaagcagcggcacaagcggaagaccgtgttgtaatcgacttcgtaggttctgtagacggtgaagagtttgaaggcggtaaagcgacagacttcactttagcaatgggtcaaagtcgtatgatccctggttttgaagaaggtatcgttggtcacaaagccggcgaacaattcgatatcgatgttactttccctgaagaataccacgctgaaaacttaaaaggtaaagcggcgaaattcgcaattacacttaagaaagtagaaaatatcgtattacctgaattaaccgaagaattcgtgaaaaaattcggttcagcaaaaactgtagaagatttacgtgcggaaattaagaaaaatatgcaacgtgaacttaaaaacgcagtaaccgcacgcgttaaaaaccaagtaatcaacggtttaatcgcacaaaatgaaattgaagtgccggctgcagcggtagcggaagaagtggacgtattacgtcgtcaagcggttcaacgtttcggtggtaaaccggaaatggctgcacaattaccggcggaattattcgaagcggatgcaaaacgtcgtgttcaagtaggtttattactttcaaccgtaatcggtactaacgaattaaaagttgatgaaaaacgtgttgaagaaacgattgcagaaatcgcttcagcttacgaacaaccggcggaagttgttgctcattatgcgaaaaaccgtcaattaaccgaaaatatccgtaacgtagtgttagaagagcaagcggttgaagttgtacttgcgaaagcaaaagtaactgaaaaagcgacttcttttgatgaagtaatggctcaacaagctcaaggctaa

SEQ ID NO: 161 - protein, 433 aa, Actinobacillus pleuropneumoniae
MSISIETLEGLQRRVTITVAADKIEAAYKEQLKGYAKNARVDGFRKGKVPHAIIEQRFGLAARQDVLSDEMQRAFFDAVIAEKINLAGRPTFTPNNYQPSQEFSFTATFEVFPEVELKGLENIEVEKPVVEITEADLDKMIDVLRKQQATWAESQAAAQAEDRVVIDFVGSVDGEEFEGGKATDFTLAMGQSRMIPGFEEGIVGHKAGEQFDIDVTFPEEYHAENLKGKAAKFAITLKKVENIVLPELTEEFVKKFGSAKTVEDLRAEIKKNMQRELKNAVTARVKNQVINGLIAQNEIEVPAAAVAEEVDVLRRQAVQRFGGKPEMAAQLPAELFEADAKRRVQVGLLLSTVIGTNELKVDEKRVEETIAEIASAYEQPAEVVAHYAKNRQLTENIRNVVLEEQAVEVVLAKAKVTEKATSFDEVMAQQAQG

SEQ ID NO: 162 - DNA, 316 bp, Actinobacillus pleuropneumoniae
  misc_feature: tRNA-glu
aatattgcgctcaaatggcaaagcggagagcatctttaaatgttgtccccatcgtctagaggcctaggacatcgccctttcacggcggtaaccggggttcgaatccccgtggggacgccatttaaagatgacttttgttgtctgaattgttctttaaaaaattggaaacaagctgaaaactgagagattttcgaaagaaagtctgagtagtaaaagataagtaattatcttgaaaatcttagctgaacaaaagcagctaagtgtttagttgaataaagtatcgcgttgaatgcgttcaaataaaatttgaaaatat

SEQ ID NO: 163 - DNA, 85 bp, Actinobacillus pleuropneumoniae
  misc_feature: tNRA-leu
gctctggtggtggaattggtagacacgctatcttgagggggtagtgtccataggatgtgcgagttcgagtctcgcccagagcacc

SEQ ID NO: 164 - DNA, 623 bp, Actinobacillus pleuropneumoniae
  CDS (1)..(621): yeaE
atgcaagaactcacacctcaaatgtggggcttagtcggcacttcaacgcttgaaacgctctatatgggctttgcggcgactttacttgctgtggtagtcggtttgccgatcggttttctggcatttttaaccggtaaaggagagattttagagaatccgcgtttacatcaagtattagatgtgattattaatatcggtcgttccgtaccgtttattattttgttagtcgtgttgttaccttttacgcgtttattggtcgggacaacgctcggtactacggcggcgattgtgccgttaagcgtttcggcaattccgttttttgcgcgtttaacttcaaatgcgttattagaaatcccagcaggtttaaccgaagcggcgaaatcgatgggcgcaacgaattggcaagtggtcagtaaattttatttaccggaatcactgccgattttaatcaatggtatcacattaactttagtcgctttaatcggttattcggcaatggcgggtgcggtcggcggcggcggtttgggtaaccttgccatcagttacggtgaacaccgaaatatggtctatgtaaaatggatctcaacaattattatcgtagcgattgtgatgatcagtcaaaa

SEQ ID NO: 165 - protein, 207 aa, Actinobacillus pleuropneumoniae
MQELTPQMWGLVGTSTLETLYMGFAATLLAVVVGLPIGFLAFLTGKGEILENPRLHQVLDVIINIGRSVPFIILLVVLLPFTRLLVGTTLGTTAAIVPLSVSAIPFFARLTSNALLEIPAGLTEAAKSMGATNWQVVSKFYLPESLPILINGITLTLVALIGYSAMAGAVGGGGLGNLAISYGEHRNMVYVKWISTIIIVAIVMISQ

The invention claimed is:

1. An isolated attenuated *Pasteurella multocida* bacterium comprising a mutation in the polynucleotide sequence that encodes the yiaO polypeptide sequence set forth in SEQ ID NO: 77, wherein the mutation results in decreased virulence and attenuation of the bacterium.

2. The bacterium of claim 1, wherein the mutation results in deletion of all or part of the polynucleotide sequence that encodes the yiaO polypeptide.

3. The bacterium of claim 1, wherein the mutation results in an insertion in the polynucleotide sequence that encodes the yiaO polypeptide.

4. An immunogenic composition comprising the bacterium according to claim 1.

5. A vaccine composition comprising the immunogenic composition according to claim 4 and a pharmaceutically acceptable carrier.

6. The vaccine composition according to claim 5, further comprising an adjuvant.

7. An isolated attenuated *Pasteurella multocida* bacterium comprising a mutation in the polynucleotide sequence that encodes a yiaO polypeptide, wherein the polynucleotide sequence hybridizes to the complement of the polynucleotide sequence set forth in SEQ ID NO: 76 under stringent conditions comprising a final wash in buffer comprising 0.2×SSC/0.1% SDS, at 65° C. to 75° C.

8. The bacterium of claim 7, wherein the mutation is in the polynucleotide sequence set forth in SEQ ID NO: 76.

9. An immunogenic composition comprising the bacterium according to claim 7 or 8.

10. A vaccine composition comprising the immunogenic composition according to claim 9 and a pharmaceutically acceptable carrier.

11. The vaccine composition of claim 10, further comprising an adjuvant.

12. An isolated attenuated *Pasteurella multocida* bacterium comprising a mutation in the polynucleotide sequence set forth in SEQ ID NO: 76 that encodes a yiaO polypeptide, wherein the mutation results in decreased virulence and attenuation of the bacterium.

13. The bacterium of claim 12, wherein the mutation results in deletion of all or part of the polynucleotide sequence that encodes the yiaO polypeptide.

14. The bacterium of claim 12, wherein the mutation results in an insertion in the polynucleotide sequence that encodes the yiaO polypeptide.

15. An immunogenic composition comprising a bacterium according to claim 12.

16. A vaccine composition comprising the immunogenic composition according to claim 15 and a pharmaceutically acceptable carrier.

* * * * *